US007927597B2

(12) United States Patent
Raitano et al.

(10) Patent No.: US 7,927,597 B2
(45) Date of Patent: Apr. 19, 2011

(54) METHODS TO INHIBIT CELL GROWTH

(75) Inventors: Arthur B. Raitano, Los Angeles, CA (US); Pia M. Challita-Eid, Encino, CA (US); Wangmao Ge, Culver City, CA (US); Juan J. Perez-Villar, Los Angeles, CA (US); Steven B. Kanner, Santa Monica, CA (US); Aya Jakobovits, Beverly Hills, CA (US)

(73) Assignee: Agensys, Inc., Santa Monica, CA (US)

( * ) Notice: Subject to any disclaimer, the term of this patent is extended or adjusted under 35 U.S.C. 154(b) by 0 days.

(21) Appl. No.: 10/837,269

(22) Filed: Apr. 30, 2004

(65) Prior Publication Data

US 2005/0191311 A1 Sep. 1, 2005

Related U.S. Application Data

(63) Continuation-in-part of application No. 10/121,024, filed on Apr. 10, 2002, now Pat. No. 7,736,654.

(60) Provisional application No. 60/467,002, filed on Apr. 30, 2003, provisional application No. 60/282,739, filed on Apr. 10, 2001.

(51) Int. Cl.
A61K 39/00 (2006.01)
(52) U.S. Cl. .................................. 424/183.1; 530/387.9
(58) Field of Classification Search .................. 435/7.1; 514/2; 530/350, 387.7
See application file for complete search history.

(56) References Cited

U.S. PATENT DOCUMENTS

| | | | |
|---|---|---|---|
| 6,150,090 A | 11/2000 | Baltimore et al. |
| 6,265,565 B1 | 7/2001 | Bandman et al. |
| 6,410,516 B1 | 6/2002 | Baltimore et al. |
| 6,414,220 B1 | 7/2002 | Vrontakis |
| 6,500,938 B1 | 12/2002 | Au-Young et al. |
| 6,518,411 B1 | 2/2003 | Murray et al. |
| 2001/0051335 A1 | 12/2001 | Lalgudi et al. |
| 2002/0022248 A1 | 2/2002 | Xu et al. |
| 2002/0098543 A1 | 7/2002 | Bandman et al. |
| 2002/0102543 A1 | 8/2002 | Friedrich et al. |
| 2002/0103125 A1 | 8/2002 | Ashkenazi et al. |
| 2002/0123463 A1 | 9/2002 | Ashkenazi et al. |
| 2002/0127584 A1 | 9/2002 | Baker et al. |
| 2002/0132252 A1 | 9/2002 | Ashkenazi et al. |
| 2002/0137139 A1 | 9/2002 | Byatt et al. |
| 2002/0142961 A1 | 10/2002 | Ashkenazi et al. |
| 2002/0147140 A1 | 10/2002 | Rosen et al. |
| 2002/0156263 A1 | 10/2002 | Chen |
| 2002/0160384 A1 | 10/2002 | Ashkenazi et al. |
| 2002/0169284 A1 | 11/2002 | Ashkenazi et al. |
| 2002/0177164 A1 | 11/2002 | Ashkenazi et al. |
| 2002/0192706 A1 | 12/2002 | Ashkenazi et al. |
| 2002/0192763 A1 | 12/2002 | Xu et al. |
| 2003/0003531 A1 | 1/2003 | Ashkenazi et al. |
| 2003/0004102 A1 | 1/2003 | Ashkenazi et al. |
| 2003/0004311 A1 | 1/2003 | Baker et al. |
| 2003/0017542 A1 | 1/2003 | Baker et al. |
| 2003/0017563 A1 | 1/2003 | Baker et al. |
| 2003/0022298 A1 | 1/2003 | Baker et al. |
| 2003/0027162 A1 | 2/2003 | Ashkenazi et al. |
| 2003/0027163 A1 | 2/2003 | Ashkenazi et al. |
| 2003/0027272 A1 | 2/2003 | Baker et al. |
| 2003/0027280 A1 | 2/2003 | Baker et al. |
| 2003/0027985 A1 | 2/2003 | Ashkenazi et al. |
| 2003/0032023 A1 | 2/2003 | Ashkenazi et al. |
| 2003/0032102 A1 | 2/2003 | Baker et al. |
| 2003/0032104 A1 | 2/2003 | Baker et al. |
| 2003/0032106 A1 | 2/2003 | Baker et al. |
| 2003/0032110 A1 | 2/2003 | Baker et al. |
| 2003/0032113 A1 | 2/2003 | Baker et al. |
| 2003/0032155 A1 | 2/2003 | Baker et al. |
| 2003/0036136 A1 | 2/2003 | Baker et al. |
| 2003/0036137 A1 | 2/2003 | Baker et al. |
| 2003/0036139 A1 | 2/2003 | Baker et al. |
| 2003/0036143 A1 | 2/2003 | Baker et al. |
| 2003/0036156 A1 | 2/2003 | Baker et al. |
| 2003/0036157 A1 | 2/2003 | Baker et al. |
| 2003/0036162 A1 | 2/2003 | Baker et al. |
| 2003/0036180 A1 | 2/2003 | Baker et al. |
| 2003/0105002 A1 | 6/2003 | Murray et al. |

FOREIGN PATENT DOCUMENTS

| | | |
|---|---|---|
| AU | 2002357734 | 5/2003 |
| CA | 2255286 | 6/1999 |
| CN | 1352259 | 6/2002 |
| EP | 1 033 401 | 9/2000 |
| EP | 1 067 182 | 1/2001 |
| EP | 1 074 617 | 2/2001 |
| EP | 1 101 820 | 5/2001 |
| EP | 1 293 569 | 3/2003 |

(Continued)

OTHER PUBLICATIONS

Greenbaum et al. (Genome Biology, 2003, vol. 4, Issue 9, pp. 117.1-117.8).*
Saffran et al, PNAS, 2001, 98:2658-2663.*
OMIM online, p. 1-4.*
Yoshida et al (Genomics, 1999, 62:540-543).*
Lopes et al (Human Genet, 2006, 119:267-275).*
Al Sarakbi et al (J of Carcinogenesis, 2006, 5:16).*
Anderson et al (Electrophoresis, 1997, 18:533-537).*
Christiansen et al (Mol Cancer Ther, 2004, 3:1493-1501).*
Topp et al (Journal of Controlled Release, 1998, 53:15-23).*
Drexler et al (Leukemia and Lymphoma, 1993, 9:1-25).*
Zellner et al (Clin. Can. Res., 1998, 4:1797-17802).*
Embleton et al (Immunol Ser, 1984, 23:181-207).*
Slamon et al, (Cancer Cells, 1989, 7:371-384).*
White et al. (2001, Ann. Rev. Med., 2001, 52:125-45).*
Greenbaum et al. (Genome Biology, 2003, vol. 4, Issue 9, pp. 117.1-117.8).*
Yoshida et al (Genomics, 1999, 62:540-543).*
Lopes et al (Human Genet, 2006, 119:267-275).*
Christiansen et al (Mol Cancer Ther, 2004, 3:1493-1501).*

(Continued)

*Primary Examiner* — Laura B Goddard
(74) *Attorney, Agent, or Firm* — Morrison & Foerster LLP

(57) ABSTRACT

A novel gene 109P1D4 and its encoded protein, and variants thereof, are described wherein 109P1D4 exhibits tissue specific expression in normal adult tissue, and is aberrantly expressed in the cancers listed in Table I. Consequently, 109P1D4 provides a diagnostic, prognostic, prophylactic and/or therapeutic target for cancer. The 109P1D4 gene or fragment thereof, or its encoded protein, or variants thereof, or a fragment thereof, can be used to elicit a humoral or cellular immune response; antibodies or T cells reactive with 109P1D4 can be used in active or passive immunization.

10 Claims, 132 Drawing Sheets

FOREIGN PATENT DOCUMENTS

| | | |
|---|---|---|
| EP | 1 308 459 | 5/2003 |
| JP | 05328975 | 12/1993 |
| JP | 07145197 | 6/1995 |
| JP | 09191883 | 7/1997 |
| JP | 11332579 | 12/1999 |
| JP | 13270871 | 10/2000 |
| WO | WO-89/07614 | 8/1989 |
| WO | WO-92/12997 | 8/1992 |
| WO | WO-92/15015 | 9/1992 |
| WO | WO-92/15681 | 9/1992 |
| WO | WO-93/16178 | 8/1993 |
| WO | WO-94/21783 | 9/1994 |
| WO | WO-95/14772 | 6/1995 |
| WO | WO-96/24379 | 8/1996 |
| WO | WO-97/39133 | 10/1997 |
| WO | WO-98/14568 | 4/1998 |
| WO | WO-98/21328 | 5/1998 |
| WO | WO-98/30585 | 7/1998 |
| WO | WO-98/32853 | 7/1998 |
| WO | WO-98/45435 | 10/1998 |
| WO | WO-98/46755 | 10/1998 |
| WO | WO-98/49299 | 11/1998 |
| WO | WO-99/03990 | 1/1999 |
| WO | WO-99/19469 | 1/1999 |
| WO | WO-99/05272 | 2/1999 |
| WO | WO-99/06439 | 2/1999 |
| WO | WO-99/06548 | 2/1999 |
| WO | WO-99/06549 | 2/1999 |
| WO | WO-99/06550 | 2/1999 |
| WO | WO-99/06551 | 2/1999 |
| WO | WO-99/06552 | 2/1999 |
| WO | WO-99/06553 | 2/1999 |
| WO | WO-99/06554 | 2/1999 |
| WO | WO-99/18207 | 4/1999 |
| WO | WO-99/22000 | 5/1999 |
| WO | WO-99/25825 | 5/1999 |
| WO | WO-99/31117 | 6/1999 |
| WO | WO-99/31236 | 6/1999 |
| WO | WO-99/33982 | 7/1999 |
| WO | WO-99/38972 | 8/1999 |
| WO | WO-99/40189 | 8/1999 |
| WO | WO-99/46281 | 9/1999 |
| WO | WO-99/48920 | 9/1999 |
| WO | WO-99/53051 | 10/1999 |
| WO | WO-99/58660 | 11/1999 |
| WO | WO-99/58675 | 11/1999 |
| WO | WO-99/63088 | 12/1999 |
| WO | WO-99/64576 | 12/1999 |
| WO | WO-00/04149 | 1/2000 |
| WO | WO-00/04153 | 1/2000 |
| WO | WO-00/06589 | 2/2000 |
| WO | WO-00/06714 | 2/2000 |
| WO | WO-00/09676 | 2/2000 |
| WO | WO-00/14251 | 3/2000 |
| WO | WO-00/18914 | 4/2000 |
| WO | WO-00/32221 | 6/2000 |
| WO | WO-00/34466 | 6/2000 |
| WO | WO-00/50629 | 8/2000 |
| WO | WO-00/52047 | 9/2000 |
| WO | WO-00/53756 | 9/2000 |
| WO | WO-00/53758 | 9/2000 |
| WO | WO-00/55173 | 9/2000 |
| WO | WO-00/55320 | 9/2000 |
| WO | WO-00/58473 | 10/2000 |
| WO | WO-00/61622 | 10/2000 |
| WO | WO-00/69900 | 11/2000 |
| WO | WO-00/70092 | 11/2000 |
| WO | WO-00/73454 | 12/2000 |
| WO | WO-00/75279 | 12/2000 |
| WO | WO-00/75661 | 12/2000 |
| WO | WO-00/77024 | 12/2000 |
| WO | WO-01/00848 | 1/2001 |
| WO | WO-01/02568 | 1/2001 |
| WO | WO-01/09318 | 2/2001 |
| WO | WO-01/12660 | 2/2001 |
| WO | WO-01/22920 | 4/2001 |
| WO | WO-01/25272 | 4/2001 |
| WO | WO-01/30972 | 5/2001 |
| WO | WO-01/34802 | 5/2001 |
| WO | WO-01/40466 | 6/2001 |
| WO | WO-01/42467 | 6/2001 |
| WO | WO-01/42472 | 6/2001 |
| WO | WO-01/51628 | 7/2001 |
| WO | WO-01/51633 | 7/2001 |
| WO | WO-01/54477 | 8/2001 |
| WO | WO-01/55312 | 8/2001 |
| WO | WO-01/55314 | 8/2001 |
| WO | WO-01/55328 | 8/2001 |
| WO | WO-01/55367 | 8/2001 |
| WO | WO-01/57058 | 8/2001 |
| WO | WO-01/57182 | 8/2001 |
| WO | WO-01/57186 | 8/2001 |
| WO | WO-01/57188 | 8/2001 |
| WO | WO-01/57190 | 8/2001 |
| WO | WO-01/57272 | 8/2001 |
| WO | WO-01/57273 | 8/2001 |
| WO | WO-01/57274 | 8/2001 |
| WO | WO-01/57275 | 8/2001 |
| WO | WO-01/57276 | 8/2001 |
| WO | WO-01/57277 | 8/2001 |
| WO | WO-01/57278 | 8/2001 |
| WO | WO-01/59063 | 8/2001 |
| WO | WO-01/60860 | 8/2001 |
| WO | WO-01/60999 | 8/2001 |
| WO | WO-01/62785 | 8/2001 |
| WO | WO-01/62927 | 8/2001 |
| WO | WO-01/63293 | 8/2001 |
| WO | WO-01/66719 | 9/2001 |
| WO | WO-01/68848 | 9/2001 |
| WO | WO-01/70976 | 9/2001 |
| WO | WO-01/71042 | 9/2001 |
| WO | WO-01/72777 | 10/2001 |
| WO | WO-01/73032 | 10/2001 |
| WO | WO-01/75067 | 10/2001 |
| WO | WO-01/77137 | 10/2001 |
| WO | WO-01/77290 | 10/2001 |
| WO | WO-01/77291 | 10/2001 |
| WO | WO-01/85177 | 11/2001 |
| WO | WO-01/86003 | 11/2001 |
| WO | WO-01/87321 | 11/2001 |
| WO | WO-01/88188 | 11/2001 |
| WO | WO-01/92581 | 12/2001 |
| WO | WO-01/94629 | 12/2001 |
| WO | WO-01/96388 | 12/2001 |
| WO | WO-01/96390 | 12/2001 |
| WO | WO-02/00677 | 1/2002 |
| WO | WO-02/00927 | 1/2002 |
| WO | WO-02/08416 | 1/2002 |
| WO | WO-02/10449 | 2/2002 |
| WO | WO-02/12314 | 2/2002 |
| WO | WO-02/12328 | 2/2002 |
| WO | WO-02/12440 | 2/2002 |
| WO | WO-02/18632 | 2/2002 |
| WO | WO-02/18424 | 3/2002 |
| WO | WO-02/18541 | 3/2002 |
| WO | WO-02/24719 | 3/2002 |
| WO | WO-02/26936 | 4/2002 |
| WO | WO-02/28999 | 4/2002 |
| WO | WO-02/29086 | 4/2002 |
| WO | WO-02/29103 | 4/2002 |
| WO | WO-02/30268 | 4/2002 |
| WO | WO-02/31111 | 4/2002 |
| WO | WO-02/38759 | 5/2002 |
| WO | WO-02/41763 | 5/2002 |
| WO | WO-02/44331 | 6/2002 |
| WO | WO-02/46467 | 6/2002 |
| WO | WO-02/50301 | 6/2002 |
| WO | WO-02/52005 | 7/2002 |
| WO | WO-02/058534 | 8/2002 |
| WO | WO-02/059271 | 8/2002 |
| WO | WO-02/060317 | 8/2002 |
| WO | WO-02/064795 | 8/2002 |
| WO | WO-02/066064 | 8/2002 |
| WO | WO-02/069900 | 9/2002 |
| WO | WO-02/070539 | 9/2002 |
| WO | WO-02/077204 | 10/2002 |
| WO | WO-02/078516 | 10/2002 |

| | | |
|---|---|---|
| WO | WO-02/079433 | 10/2002 |
| WO | WO-02/079449 | 10/2002 |
| WO | WO-02/083921 | 10/2002 |
| WO | WO-02/085298 | 10/2002 |
| WO | WO-02/090992 | 11/2002 |
| WO | WO-02/095000 | 11/2002 |
| WO | WO-02/097031 | 12/2002 |
| WO | WO-02/097090 | 12/2002 |
| WO | WO-02/102982 | 12/2002 |
| WO | WO-03/012082 | 2/2003 |
| WO | WO-03/016549 | 2/2003 |
| WO | WO-03/022300 | 4/2003 |
| WO | WO-03/045989 | 6/2003 |

OTHER PUBLICATIONS

Topp et al (Journal of Controlled Release, 1998, 53:15-23).*
Drexler et al (Leukemia and Lymphoma, 1993, 9:1-25).*
Zellner et al (Clin. Can. Res., 1998, 4:1797-17802).*
Embleton et al (Immunol Ser, 1984, 23:181-207).*
Slamon et al, (Cancer Cells, 1989, 7:371-384).*
White et al. (2001, Ann. Rev. Med., 2001, 52:125-145).*
Benedict et al (J. Exp. Medicine, 2001, 193(1)89-99).*
Hirashima (Int. Arch. Allergy Immunol., 2000, Suppl 1:6-9).*
Jiang et al (JBC, 2003, 278(7) 4763-4769).*
Weiner et al (Seminars in Oncology, 1999, 26 (5 Supplement 14):43-51).*
Greenbaum et al. (Genome Biology, 2003, vol. 4, Issue 9, pp. 117.1-117.8).*
Lawrie et al (J Clinical Pathology: Mol Pathol, 2001, 54:253-258).*
Yoshida et al (Genomics, 1999, 62:540-543).*
Lopes et al (Human Genet, 2006, 119:267-275).*
Christiansen et al (Mol Cancer Ther, 2004, 3:1493-1501).*
Topp et al (Journal of Controlled Release, 1998, 53:15-23).*
Meibohm (Pharmacokinetics and Pharmacodynamics of Biotech Drugs, Wiley-VHC, 2006, chapter 3, p. 45-91).*
Drexler et al (Leukemia and Lymphoma, 1993, 9:1-25).*
Zellner et al (Clin. Can. Res., 1998, 4:1797-17802).*
Embleton et al (Immunol Ser, 1984, 23:181-207).*
Slamon et al, (Cancer Cells, 1989, 7:371-384).*
White et al. (2001, Ann. Rev. Med., 2001, 52:125-145).*
Australian Office Action for Application No. 2004235755, date mailed Dec. 7, 2006, 3 pages.
Blanco et al., GenBank Accession No. AJ276803 (2005).
Blanco et al., GenBank Accession No. AJ276804 (2005).
Chen et al., GenBank Accession No. AF277053 (2002).
Dunham et al., GenBank Accession No. NM 020403 (2007).
Kools and Van Roy, GenBank Accession No. AF206516 (2001).
Kools and Van Roy, GenBank Accession No. AF217288 (2001).
Skaletsky et al., GenBank Accession No. AF332217 (2003).
Skaletsky et al., GenBank Accession No. AF332218 (2003).
Skaletsky et al., GenBank Accession No. AF332219 (2003).
Yoshida and Sugano, GenBank Accession No. AB026187 (2000).
International Search Report and Written Opinion for PCT/US04/13568, mailed Jul. 18, 2008, 6 pages.
Blanco et al., Mammalian Genome (2000) 11:906-914.
Printout from webpage, Q9BZA7 (Uniprot), http://www.proteinatlas.org/tissue_profile.php?antibody_id=HPA000432.
Wilson et al., Chromosome Research (2007) 15:485-498.
Wilson et al., Cytogenet Genome Res (2006) 114:137-139.

* cited by examiner

Figure 1: 109P1D4 SSH sequence of 192 nucleotides. (SEQ ID NO:1)

```
  1 GATCCTGGTT GCAGCTGTTG CTGGCACCAT AACTGTCGTT GTAGTTATTT TCATCACTGC
 61 TGTAGTAAGA TGTCGCCAGG CACACACCTT AAGGCTGCTC AGAAAAACAT GCAGAATTCT
121 GAATGGGCTA CCCCAAACCC AGAAAACAGG CAGATGATAA AAAAAAAAAA AAAAAAAAA
181 AAAAGCTTGA TC
```

Figure 2:

Figure 2A. The cDNA (SEQ ID NO:2) and amino acid sequence (SEQ ID NO:3) of 109P1D4 v.1. The start methionine is underlined. The open reading frame extends from nucleic acid 846-3911 including the stop codon.

```
   1 ctggtggtccagtacctccaaagatatggaatacactcctgaaatatcctgaaaactttt
  61 tttttcagaatcctttaataagcagttatgtcaatctgaaagttgcttacttgtacttt
 121 atattaatagctattcttgttttcttatccaaagaaaaatcctctaatccccttttcac
 181 atgatagttgttaccatgtttaggcattagtcacatcaaccctctcctctcccaaactt
 241 ctcttcttcaaatcaaactttattagtccctcctttataatgattccttgcctcgtttta
 301 tccagatcaattttttttcactttgatgcccagagctgaagaaatggactactgtataaa
 361 ttattcattgccaagagaataattgcattttaaacccatattataacaaagaataatgat
 421 tatattttgtgatttgtaacaaatacccttattttcccttaactattgaattaaatatt
 481 ttaattatttgtattctcttttaactatcttggtatattaaagtattatcttttatatatt
 541 tatcaatggtggacacttttataggtactctgtgtcattttgatactgtaggtatctta
 601 tttcatttatctttattcttaatgtacgaattcataatatttgattcagaacaaatttat
 661 cactaattaacagagtgtcaattatgctaacatctcatttactgattttaatttaaaaca
 721 gttttgttaacatgcatgtttaggggttggcttcttaataatttcttcttcctcttctct
 781 ctctcctcttcttttggtcagtgttgtgcgggttaatacaacaaactgtaacaagtgtac
```

```
   1        M  D  L  L  S  G  T  Y  I  F  A  V  L  L  A  C  V  V  F
 841 ctggtATGGACTTGTTGTCCGGGACGTACATTTTCGCGGTCCTGCTAGCATGCGTGGTGT
  20  H  S  G  A  Q  E  K  N  Y  T  I  R  E  E  M  P  E  N  V  L
 901 TCCACTCTGGCGCCCAGGAGAAAAACTACACCATCCGAGAAGAAATGCCAGAAAACGTCC
  40  I  G  D  L  L  K  D  L  N  L  S  I  P  N  K  S  L  T  T
 961 TGATAGGCGACTTGTTGAAAGACCTTAACTTGTCGCTGATTCCAAACAAGTCCTTGACAA
  60  A  M  Q  F  K  L  V  Y  K  T  G  D  V  P  L  I  R  I  E  E
1021 CTGCTATGCAGTTCAAGCTAGTGTACAAGACCGGAGATGTGCCACTGATTCGAATTGAAG
  80  D  T  G  E  I  F  T  T  G  A  R  I  D  R  E  K  L  C  A  G
1081 AGGATACTGGTGAGATCTTCACTACTGGCGCTCGCATTGATCGTGAGAAATTATGTGCTG
 100  I  P  R  D  E  H  C  F  Y  E  V  E  V  A  I  L  P  D  E  I
1141 GTATCCCAAGGGATGAGCATTGCTTTTATGAAGTGGAGGTTGCCATTTTGCCGGATGAAA
 120  F  R  L  V  K  I  R  F  L  I  E  D  I  N  D  N  A  P  L  F
1201 TATTTAGACTGGTTAAGATACGTTTTCTGATAGAAGATATAAATGATAATGCACCATTGT
 140  P  A  T  V  I  N  I  S  I  P  E  N  S  A  I  N  S  K  Y  T
1261 TCCCAGCAACAGTTATCAACATATCAATTCCAGAGAACTCGGCTATAAACTCTAAATATA
 160  L  P  A  A  V  D  P  D  V  G  I  N  G  V  Q  N  Y  E  L  I
1321 CTCTCCCAGCGGCTGTTGATCCTGACGTAGGAATAAACGGAGTTCAAAACTACGAACTAA
 180  K  S  Q  N  I  F  G  L  D  V  I  E  T  P  E  G  D  K  M  P
1381 TTAAGAGTCAAAACATTTTTGGCCTCGATGTCATTGAAACACCAGAAGGAGACAAGATGC
 200  Q  L  I  V  Q  K  E  L  D  R  E  E  K  D  T  Y  V  M  K  V
1441 CACAACTGATTGTTCAAAAGGAGTTAGATAGGGAAGAGAAGGATACCTACGTGATGAAAG
 220  K  V  E  D  G  G  F  P  Q  R  S  S  T  A  I  L  Q  V  S  V
1501 TAAAGGTTGAAGATGGTGGCTTTCCTCAAAGATCCAGTACTGCTATTTTGCAAGTGAGTG
 240  T  D  T  N  D  N  H  P  V  F  K  E  T  E  I  E  V  S  I  P
```

Figure 2A-2

```
1561 TTACTGATACAAATGACAACCACCCAGTCTTTAAGGAGACAGAGATTGAAGTCAGTATAC
 260   E  N  A  P  V  G  T  S  V  T  Q  L  H  A  T  D  A  D  I  G
1621 CAGAAAATGCTCCTGTAGGCACTTCAGTGACACAGCTCCATGCCACAGATGCTGACATAG
 280   E  N  A  K  I  H  F  S  F  S  N  L  V  S  N  I  A  R  R  L
1681 GTGAAAATGCCAAGATCCACTTCTCTTTCAGCAATCTAGTCTCCAACATTGCCAGGAGAT
 300   F  H  L  N  A  T  T  G  L  I  T  I  K  E  P  L  D  R  E  E
1741 TATTTCACCTCAATGCCACCACTGGACTTATCACAATCAAAGAACCACTGGATAGGGAAG
 320   T  P  N  H  K  L  L  V  L  A  S  D  G  G  L  M  P  A  R  A
1801 AAACACCAAACCACAAGTTACTGGTTTTGGCAAGTGATGGTGGATTGATGCCAGCAAGAG
 340   M  V  L  V  N  V  T  D  V  N  D  N  V  P  S  I  D  I  R  Y
1861 CAATGGTGCTGGTAAATGTTACAGATGTCAATGATAATGTCCCATCCATTGACATAAGAT
 360   I  V  N  P  V  N  D  T  V  V  L  S  E  N  I  P  L  N  T  K
1921 ACATCGTCAATCCTGTCAATGACACAGTTGTTCTTTCAGAAAATATTCCACTCAACACCA
 380   I  A  L  I  T  V  T  D  K  D  A  D  H  N  G  R  V  T  C  F
1981 AAATTGCTCTCATAACTGTGACGGATAAGGATGCGGACCATAATGGCAGGGTGACATGCT
 400   T  D  H  E  I  P  F  R  L  R  P  V  F  S  N  Q  F  L  L  E
2041 TCACAGATCATGAAATCCCTTTCAGATTAAGGCCAGTATTCAGTAATCAGTTCCTCCTGG
 420   T  A  A  Y  L  D  Y  E  S  T  K  E  Y  A  I  K  L  L  A  A
2101 AGACTGCAGCATATCTTGACTATGAGTCCACAAAAGAATATGCCATTAAATTACTGGCTG
 440   D  A  G  K  P  P  L  N  Q  S  A  M  L  F  I  K  V  K  D  E
2161 CAGATGCTGGCAAACCTCCTTTGAATCAGTCAGCAATGCTCTTCATCAAAGTGAAAGATG
 460   N  D  N  A  P  V  F  T  Q  S  F  V  T  V  S  I  P  E  N  N
2221 AAAATGACAATGCTCCAGTTTTCACCCAGTCTTTCGTAACTGTTTCTATTCCTGAGAATA
 480   S  P  G  I  Q  L  T  K  V  S  A  M  D  A  D  S  G  P  N  A
2281 ACTCTCCTGGCATCCAGTTGACGAAAGTAAGTGCAATGGATGCAGACAGTGGGCCTAATG
 500   K  I  N  Y  L  L  G  P  D  A  P  P  E  F  S  L  D  C  R  T
2341 CTAAGATCAATTACCTGCTAGGCCCTGATGCTCCACCTGAATTCAGCCTGGATTGTCGTA
 520   G  M  L  T  V  V  K  L  D  R  E  K  E  D  K  Y  L  F  T
2401 CAGGCATGCTGACTGTAGTGAAGAAACTAGATAGAGAAAAAGAGGATAAATATTTATTCA
 540   I  L  A  K  D  N  G  V  P  P  L  T  S  N  V  T  V  F  V  S
2461 CAATTCTGGCAAAAGATAACGGGGTACCACCCTTAACCAGCAATGTCACAGTCTTTGTAA
 560   I  I  D  Q  N  D  N  S  P  V  F  T  H  N  E  Y  N  F  Y  V
2521 GCATTATTGATCAGAATGACAATAGCCCAGTTTTCACTCACAATGAATACAACTTCTATG
 580   P  E  N  L  P  R  H  G  T  V  G  L  I  T  V  T  D  P  D  Y
2581 TCCCAGAAAACCTTCCAAGGCATGGTACAGTAGGACTAATCACTGTAACTGATCCTGATT
 600   G  D  N  S  A  V  T  L  S  I  L  D  E  N  D  D  F  T  I  D
2641 ATGGAGACAATTCTGCAGTTACGCTCTCCATTTTAGATGAGAATGATGACTTCACCATTG
 620   S  Q  T  G  V  I  R  P  N  I  S  F  D  R  E  K  Q  E  S  Y
2701 ATTCACAAACTGGTGTCATCCGACCAAATATTTCATTTGATAGAGAAAAACAAGAATCTT
 640   T  F  Y  V  K  A  E  D  G  G  R  V  S  R  S  S  S  A  K  V
2761 ACACTTTCTATGTAAAGGCTGAGGATGGTGGTAGAGTATCACGTTCTTCAAGTGCCAAAG
```

Figure 2A-3

```
      660       T  I  N  V  V  D  V  N  D  N  K  P  V  F  I  V  P  P  S  N
     2821 TAACCATAAATGTGGTTGATGTCAATGACAACAAACCAGTTTTCATTGTCCCTCCTTCCA
      680       C  S  Y  E  L  V  L  P  S  T  N  P  G  T  V  V  F  Q  V  I
     2881 ACTGTTCTTATGAATTGGTTCTACCGTCCACTAATCCAGGCACAGTGGTCTTTCAGGTAA
      700       A  V  D  N  D  T  G  M  N  A  E  V  R  Y  S  I  V  G  G  N
     2941 TTGCTGTTGACAATGACACTGGCATGAATGCAGAGGTTCGTTACAGCATTGTAGGAGGAA
      720       T  R  D  L  F  A  I  D  Q  E  T  G  N  I  T  L  M  E  K  C
     3001 ACACAAGAGATCTGTTTGCAATCGACCAAGAAACAGGCAACATAACATTGATGGAGAAAT
      740       D  V  T  D  L  G  L  H  R  V  L  V  K  A  N  D  L  G  Q  P
     3061 GTGATGTTACAGACCTTGGTTTACACAGAGTGTTGGTCAAAGCTAATGACTTAGGACAGC
      760       D  S  L  F  S  V  V  I  V  N  L  F  V  N  E  S  V  T  N  A
     3121 CTGATTCTCTCTTCAGTGTTGTAATTGTCAATCTGTTCGTGAATGAGTCGGTGACCAATG
      780       T  L  I  N  E  L  V  R  K  S  T  E  A  P  V  T  P  N  T  E
     3181 CTACACTGATTAATGAACTGGTGCGCAAAAGCACTGAAGCACCAGTGACCCCAAATACTG
      800       I  A  D  V  S  S  P  T  S  D  Y  V  K  I  L  V  A  A  V  A
     3241 AGATAGCTGATGTATCCTCACCAACTAGTGACTATGTCAAGATCCTGGTTGCAGCTGTTG
      820       G  T  I  T  V  V  V  I  F  I  T  A  V  V  R  C  R  Q  A
     3301 CTGGCACCATAACTGTCGTTGTAGTTATTTTCATCACTGCTGTAGTAAGATGTCGCCAGG
      840       P  H  L  K  A  A  Q  K  N  Q  N  S  E  W  A  T  P  N  P
     3361 CACCACACCTTAAGGCTGCTCAGAAAAACAAGCAGAATTCTGAATGGGCTACCCCAAACC
      860       E  N  R  Q  M  I  M  M  K  K  K  K  K  K  K  H  S  P  K
     3421 CAGAAAACAGGCAGATGATAATGATGAAGAAAAAGAAAAAGAAGAAGAAGCATTCCCCTA
      880       N  L  L  N  F  V  T  I  E  E  T  K  A  D  D  V  D  S  D
     3481 AGAACTTGCTGCTTAATTTTGTCACTATTGAAGAAACTAAGGCAGATGATGTTGACAGTG
      900       G  N  R  V  T  L  D  L  P  I  D  L  E  E  Q  T  M  G  K  Y
     3541 ATGGAAACAGAGTCACACTAGACCTTCCTATTGATCTAGAAGAGCAAACAATGGGAAAGT
      920       N  W  V  T  T  P  T  T  F  K  P  D  S  P  D  L  A  R  H  Y
     3601 ACAATTGGGTAACTACACCTACTACTTTCAAGCCCGACAGCCCTGATTTGGCCCGACACT
      940       K  S  A  S  P  Q  P  A  F  Q  I  Q  P  E  T  P  L  N  S  K
     3661 ACAAATCTGCCTCTCCACAGCCTGCCTTCCAAATTCAGCCTGAAACTCCCCTGAATTCGA
      960       H  H  I  I  Q  E  L  P  L  D  N  T  F  V  A  C  D  S  I  S
     3721 AGCACCACATCATCCAAGAACTGCCTCTCGATAACACCTTTGTGGCCTGTGACTCTATCT
      980       K  C  S  S  S  S  D  P  Y  S  V  S  D  C  G  Y  P  V  T
     3781 CCAAGTGTTCCTCAAGCAGTTCAGATCCCTACAGCGTTTCTGACTGTGGCTATCCAGTGA
     1000       T  F  E  V  P  V  S  V  H  T  R  P  V  G  I  Q  V  S  N  T
     3841 CGACCTTCGAGGTACCTGTGTCCGTACACACCAGACCGGTAGGTATCCAAGTTTCTAACA
     1020       T  F  *
     3901 CAACTTTCTAActatttttttattattattttcagttgatgtagaactttacaaaatcta
     3961 ttgacttcaaagaggggatcaaaacaatcatattctacagatgtacccaatagatatatgg
     4021 attcaattaagtttggtagaagatgagaacaaaataactactgatttaggaaaattggat
     4081 gcagaataataatttatagtaggggcaattttgtctgtagatggcagtatgacaattcttg
```

Figure 2A-4

```
4141 ctagagaatatattgaaaaaaacttcaacacaaagggttgtagcactgtcctcagtacca
4201 ttgtgtgcatgaggatcagaatagtctgggctagatacatcacattaaagcttttcagaa
4261 tctgataaatagctctaaatactaatgatattgagaagcctagcttcacttgggaaaatc
4321 tgtggctgttcacagaaattcagcaccaagttattcccccatactctaccaggccttca
4381 ggtcctcataaagaaaagtgtcgttttcagattaggaactcaaaattattttggtgcatc
4441 aaatctacagtcacacaatataacaagaatgggattagaaaaatgaaagcctactcattc
4501 tcatctttaagccagagaatgaaatatatgaggtctctggatagctatttaaatattt
4561 gcatatttatgcaaggtattttgagcccttcagaagacattct
```

Figure 2B. The cDNA (SEQ ID NO:4) and amino acid sequence (SEQ ID NO:5) of 109P1D4 v.2.

The start methionine is underlined. The open reading frame extends from nucleic acid 503-3667 including the stop codon.

```
   1 cccctttctcccccctcggttaagtccctcccccctcgccattcaaaagggctggctcggca
  61 ctggctccttgcagtcggcgaactgtcggggcgggaggagccgtgagcagtagctgcact
 121 cagctgcccgcgcggcaaagaggaaggcaagccaaacagagtgcgcagagtggcagtgcc
 181 agcggcgacacaggcagcacaggcagcccgggctgcctgaatagcctcagaaacaacctc
 241 agcgactccggctgctctgcggactgcgagctgtggcggtagagcccgctacagcagtcg
 301 cagtctccgtggagcgggcggaagccttttttctcccttcgtttacctcttcattctac
 361 tctaaaggcatcgttattaggaaaatcctgttgcgaataagaaggattccacagatcaca
 421 taccggagaggttttgcctcagctgctctcaactttgtaatcttgtgaagaagctgacaa
   1                           M  R  T  E  R  Q  W  V  L  I  Q  I  F
 481 gcttggctgattgcagagcactATGAGGACTGAACGACAGTGGGTTTTAATTCAGATATT
  14  Q  V  L  C  G  L  I  Q  Q  T  V  T  S  V  P  G  M  D  L  L
 541 TCAAGTGTTGTGCGGGTTAATACAACAAACTGTAACAAGTGTACCTGGTATGGACTTGTT
  34  S  G  T  Y  I  F  A  V  L  L  A  C  V  V  F  H  S  G  A  Q
 601 GTCCGGGACGTACATTTTCGCGGTCCTGCTAGCATGCGTGGTGTTCCACTCTGGCGCCCA
  54  E  K  N  Y  I  R  E  E  M  P  E  N  V  L  I  G  D  L  L
 661 GGAGAAAAACTACACCATCCGAGAAGAAATGCCAGAAAACGTCCTGATAGGCGACTTGTT
  74  K  D  L  N  L  S  I  P  N  K  S  L  T  T  A  M  Q  F  K
 721 GAAAGACCTTAACTTGTCGCTGATTCCAAACAAGTCCTTGACAACTGCTATGCAGTTCAA
  94  L  V  Y  K  T  G  D  V  P  L  I  R  I  E  E  D  T  G  E  I
 781 GCTAGTGTACAAGACCGGAGATGTGCCACTGATTCGAATTGAAGAGGATACTGGTGAGAT
 114  F  T  T  G  A  R  I  D  R  E  K  L  C  A  G  I  P  R  D  E
 841 CTTCACTACTGGCGCTCGCATTGATCGTGAGAAATTATGTGCTGGTATCCCAAGGGATGA
 134  H  C  F  Y  E  V  E  V  A  I  L  P  D  E  I  F  R  L  V  K
 901 GCATTGCTTTTATGAAGTGGAGGTTGCCATTTTGCCGGATGAAATATTTAGACTGGTTAA
 154  I  R  F  L  I  E  D  I  N  D  N  A  P  L  F  P  A  T  V  I
 961 GATACGTTTTCTGATAGAAGATATAAATGATAATGCACCATTGTTCCCAGCAACAGTTAT
 174  N  I  S  I  P  E  N  S  A  I  N  S  K  Y  T  L  P  A  V
1021 CAACATATCAATTCCAGAGAACTCGGCTATAAACTCTAAATATACTCTCCCAGCGGCTGT
 194  D  P  D  V  G  I  N  G  V  Q  N  Y  E  L  I  K  S  Q  N  I
1081 TGATCCTGACGTAGGAATAAACGGAGTTCAAAACTACGAACTAATTAAGAGTCAAAACAT
```

Figure 2B-2

```
 214  F  G  L  D  V  I  E  T  P  E  G  D  K  M  P  Q  L  I  V  Q
1141  TTTTGGCCTCGATGTCATTGAAACACCAGAAGGAGACAAGATGCCACAACTGATTGTTCA
 234  K  E  L  D  R  E  E  K  D  T  Y  V  M  K  V  K  V  E  D  G
1201  AAAGGAGTTAGATAGGGAAGAGAAGGATACCTACGTGATGAAAGTAAAGGTTGAAGATGG
 254  G  F  P  Q  R  S  S  T  A  I  L  Q  V  S  V  T  D  T  N  D
1261  TGGCTTTCCTCAAAGATCCAGTACTGCTATTTTGCAAGTGAGTGTTACTGATACAAATGA
 274  N  H  P  V  F  K  E  T  E  I  E  V  S  I  P  E  N  A  P  V
1321  CAACCACCCAGTCTTTAAGGAGACAGAGATTGAAGTCAGTATACCAGAAAATGCTCCTGT
 294  G  T  S  V  T  Q  L  H  A  T  D  A  D  I  G  E  N  A  K  I
1381  AGGCACTTCAGTGACACAGCTCCATGCCACAGATGCTGACATAGGTGAAAATGCCAAGAT
 314  H  F  S  F  S  N  L  V  S  N  I  A  R  R  L  F  H  L  N  A
1441  CCACTTCTCTTTCAGCAATCTAGTCTCCAACATTGCCAGGAGATTATTTCACCTCAATGC
 334  T  T  G  L  I  T  I  K  E  P  L  D  R  E  E  T  P  N  H  K
1501  CACCACTGGACTTATCACAATCAAAGAACCACTGGATAGGGAAGAAACACCAAACCACAA
 354  L  L  V  L  A  S  D  G  G  L  M  P  A  R  A  M  V  L  V  N
1561  GTTACTGGTTTTGGCAAGTGATGGTGGATTGATGCCAGCAAGAGCAATGGTGCTGGTAAA
 374  V  T  D  V  N  D  N  V  P  S  I  D  I  R  Y  I  V  N  P  V
1621  TGTTACAGATGTCAATGATAATGTCCCATCCATTGACATAAGATACATCGTCAATCCTGT
 394  N  D  T  V  V  L  S  E  N  I  P  L  N  T  K  I  A  L  I  T
1681  CAATGACACAGTTGTTCTTTCAGAAAATATTCCACTCAACACCAAAATTGCTCTCATAAC
 414  V  T  D  K  D  A  D  H  N  G  R  V  T  C  F  T  D  H  E  I
1741  TGTGACGGATAAGGATGCGGACCATAATGGCAGGGTGACATGCTTCACAGATCATGAAAT
 434  P  F  R  L  R  P  V  F  S  N  Q  F  L  L  E  T  A  A  Y  L
1801  CCCTTTCAGATTAAGGCCAGTATTCAGTAATCAGTTCCTCCTGGAGACTGCAGCATATCT
 454  D  Y  E  S  T  K  E  Y  A  I  K  L  L  A  A  D  A  G  K  P
1861  TGACTATGAGTCCACAAAAGAATATGCCATTAAATTACTGGCTGCAGATGCTGGCAAACC
 474  P  L  N  Q  S  A  M  L  F  I  K  V  K  D  E  N  D  N  A  P
1921  TCCTTTGAATCAGTCAGCAATGCTCTTCATCAAAGTGAAAGATGAAAATGACAATGCTCC
 494  V  F  T  Q  S  F  V  T  V  S  I  P  E  N  N  S  P  G  I  Q
1981  AGTTTTCACCCAGTCTTTCGTAACTGTTTCTATTCCTGAGAATAACTCTCCTGGCATCCA
 514  L  T  K  V  S  A  M  D  A  D  S  G  P  N  A  K  I  N  Y  L
2041  GTTGACGAAAGTAAGTGCAATGGATGCAGACAGTGGGCCTAATGCTAAGATCAATTACCT
 534  L  G  P  D  A  P  P  E  F  S  L  D  C  R  T  G  M  L  T  V
2101  GCTAGGCCCTGATGCTCCACCTGAATTCAGCCTGGATTGTCGTACAGGCATGCTGACTGT
 554  V  K  K  L  D  R  E  K  E  D  K  Y  L  F  T  I  L  A  K  D
2161  AGTGAAGAAACTAGATAGAGAAAAAGAGGATAAATATTTATTCACAATTCTGGCAAAAGA
 574  N  G  V  P  P  L  T  S  N  V  T  V  F  V  S  I  I  D  Q  N
2221  TAACGGGGTACCACCCTTAACCAGCAATGTCACAGTCTTTGTAAGCATTATTGATCAGAA
 594  D  N  S  P  V  F  T  H  N  E  Y  N  F  Y  V  P  E  N  L  P
2281  TGACAATAGCCCAGTTTTCACTCACAATGAATACAACTTCTATGTCCCAGAAAACCTTCC
 614  R  H  G  T  V  G  L  I  T  V  T  D  P  D  Y  G  D  N  S  A
```

Figure 2B-3

```
2341 AAGGCATGGTACAGTAGGACTAATCACTGTAACTGATCCTGATTATGGAGACAATTCTGC
 634  V  T  L  S  I  L  D  E  N  D  D  F  T  I  D  S  Q  T  G  V
2401 AGTTACGCTCTCCATTTTAGATGAGAATGATGACTTCACCATTGATTCACAAACTGGTGT
 654  I  R  P  N  I  S  F  D  R  E  K  Q  E  S  Y  T  F  Y  V  K
2461 CATCCGACCAAATATTTCATTTGATAGAGAAAAACAAGAATCTTACACTTTCTATGTAAA
 674  A  E  D  G  G  R  V  S  R  S  S  S  A  K  V  T  I  N  V  V
2521 GGCTGAGGATGGTGGTAGAGTATCACGTTCTTCAAGTGCCAAAGTAACCATAAATGTGGT
 694  D  V  N  D  N  K  P  V  F  I  V  P  S  N  C  S  Y  E  L
2581 TGATGTCAATGACAACAAACCAGTTTTCATTGTCCCTCCTTCCAACTGTTCTTATGAATT
 714  V  L  P  S  T  N  P  G  T  V  V  F  Q  V  I  A  V  D  N  D
2641 GGTTCTACCGTCCACTAATCCAGGCACAGTGGTCTTTCAGGTAATTGCTGTTGACAATGA
 734  T  G  M  N  A  E  V  R  Y  S  I  V  G  G  N  T  R  D  L  F
2701 CACTGGCATGAATGCAGAGGTTCGTTACAGCATTGTAGGAGGAAACACAAGAGATCTGTT
 754  A  I  D  Q  E  T  G  N  I  T  L  M  E  K  C  D  V  T  D  L
2761 TGCAATCGACCAAGAAACAGGCAACATAACATTGATGGAGAAATGTGATGTTACAGACCT
 774  G  L  H  R  V  L  V  K  A  N  D  L  G  Q  P  D  S  L  F  S
2821 TGGTTTACACAGAGTGTTGGTCAAAGCTAATGACTTAGGACAGCCTGATTCTCTCTTCAG
 794  V  V  I  V  N  L  F  V  N  E  S  V  T  N  A  T  L  I  N  E
2881 TGTTGTAATTGTCAATCTGTTCGTGAATGAGTCGGTGACCAATGCTACACTGATTAATGA
 814  L  V  R  K  S  T  E  A  P  V  T  P  N  T  E  I  A  D  V  S
2941 ACTGGTGCGCAAAAGCACTGAAGCACCAGTGACCCCAAATACTGAGATAGCTGATGTATC
 834  S  F  T  S  D  Y  V  K  I  L  V  A  A  V  A  G  T  I  T  V
3001 CTCACCAACTAGTGACTATGTCAAGATCCTGGTTGCAGCTGTTGCTGGCACCATAACTGT
 854  V  V  I  F  I  T  A  V  V  R  C  R  Q  A  P  H  L  K  A
3061 CGTTGTAGTTATTTTCATCACTGCTGTAGTAAGATGTCGCCAGGCACCACACCTTAAGGC
 874  A  Q  K  N  K  Q  N  S  E  W  A  T  P  N  P  E  N  R  Q  M
3121 TGCTCAGAAAAACAAGCAGAATTCTGAATGGGCTACCCCAAACCCAGAAAACAGGCAGAT
 894  I  M  M  K  K  K  K  K  K  K  H  S  P  K  N  L  L  L  N
3181 GATAATGATGAAGAAAAAGAAAAAGAAGAAGAAGCATTCCCCTAAGAACTTGCTGCTTAA
 914  F  V  T  I  E  E  T  K  A  D  D  V  D  S  D  G  N  R  V  T
3241 TTTTGTCACTATTGAAGAAACTAAGGCAGATGATGTTGACAGTGATGGAAACAGAGTCAC
 934  L  D  L  F  I  D  L  E  E  Q  T  M  G  K  Y  N  W  V  T  T
3301 ACTAGACCTTCCTATTGATCTAGAAGAGCAAACAATGGGAAAGTACAATTGGGTAACTAC
 954  P  T  T  F  K  P  D  S  P  D  L  A  R  H  Y  K  S  A  S  P
3361 ACCTACTACTTTCAAGCCCGACAGCCCTGATTTGGCCCGACACTACAAATCTGCCTCTCC
 974  Q  P  A  F  Q  I  Q  P  E  T  P  L  N  S  K  H  H  I  I  Q
3421 ACAGCCTGCCTTCCAAATTCAGCCTGAAACTCCCCTGAATTCGAAGCACCACATCATCCA
 994  E  L  P  L  D  N  T  F  V  A  C  D  S  I  S  K  C  S  S  S
3481 AGAACTGCCTCTCGATAACACCTTTGTGGCCTGTGACTCTATCTCCAAGTGTTCCTCAAG
1014  S  S  D  P  Y  S  V  S  D  C  G  Y  P  V  T  T  F  E  V  P
3541 CAGTTCAGATCCCTACAGCGTTTCTGACTGTGGCTATCCAGTGACGACCTTCGAGGTACC
```

Figure 2B-4

```
1034   V  S  V  H  T  R  P  T  D  S  R  T  S  T  I  E  I  C  S  E
3601 TGTGTCCGTACACACCAGACCGACTGATTCCAGGACATCAACTATTGAAATCTGCAGTGA
1054   I  *
3661 GATATAActttctaggaacaacaaaattccattcccttccaaaaaatttcaatgattgt
3721 gatttcaaaattaggctaagatcattaattttgtaatctagatttcccattataaaagca
3781 agcaaaaatcatcttaaaaatgatgtcctagtgaaccttgtgctttctttagctgtaatc
3841 tggcaatggaaatttaaaatttatggaagagacagtgcagcacaataacagagtactctc
3901 atgctgtttctctgtttgctctgaatcaacagccatgatgtaatataaggctgtcttggt
3961 gtatacacttatggttaatatatcagtcatgaaacatgcaattacttgccctgtctgatt
4021 gttgaataattaaaacattatctccaggagtttggaagtgagctgaactagccaaactac
4081 tctctgaaaggtatccagggcaagagacattttttaagaccccaaacaaacaaaaaacaaa
4141 accaaaacactctggttcagtgttttgaaaatattcactaacataatattgctgagaaaa
4201 tcatttttattacccaccactctgcttaaaagttgagtgggccgggcgcggtggctcacg
4261 cctgtaatcccagcactttgggaggccgaggcgggtggatcacgaggtcaggagattgag
4321 accatcctggctaacacggtgaaaccccatctccactaaaaatacaaaaaattagcctgg
4381 cgtggtggcgggcgcctgtagtcccagctactcgggaggctgaggcaggagaatagcgtg
4441 aacccgggaggcggagcttgcagtgagccgagatggcgccactgcactccagcctgggtg
4501 acagagcaagactctgtctcaaaaagaaaaaaatgttcaatgatagaaataattttact
4561 aggttttttatgttgattgtactcatgctgttccactccttttaattattaaaaagttatt
4621 tttggctgggtgtggtggctcacacctgtaatcccagcactttgggaggccgaggtgggt
4681 ggatcacctgaggtcaggagttcaagaccagtctggccaacat
```

Figure 2C. The cDNA (SEQ ID NO:6) and amino acid sequence (SEQ ID NO:7) of 109P1D4 v.3. The start methionine is underlined. The open reading frame extends from nucleic acid 846-4889 including the stop codon.

```
  1 ctggtggtccagtacctccaaagatatggaatacactcctgaaatatcctgaaaacttttt
 61 ttttttcagaatcctttaataagcagttatgtcaatctgaaagttgcttacttgtacttt
121 atattaatagctattcttgttttcttatccaaagaaaaatcctctaatccccttttcac
181 atgatagttgttaccatgtttaggcattagtcacatcaaccccctcctctcccaaactt
241 ctcttcttcaaatcaaactttattagtccctcctttataatgattccttgcctcgtttta
301 tccagatcaattttttttcactttgatgcccagagctgaagaaatggactactgtataaa
361 ttattcattgccaagagaataattgcattttaaacccatattataacaaagaataatgat
421 tatattttgtgatttgtaacaaatacccttttattttcccttaactattgaattaaatatt
481 ttaattatttgtattctctttaactatcttggtatattaaagtattatcttttatatatt
541 tatcaatggtggacacttttataggtactctgtgtcattttgatactgtaggtatctta
601 tttcatttatctttattcttaatgtacgaattcataatatttgattcagaacaaatttat
661 cactaattaacagagtgtcaattatgctaacatctcatttactgattttaatttaaaaca
721 gttttttgttaacatgcatgtttaggggttggcttcttaataatttcttcttcctcttctct
781 ctctcctcttcttttggtcagtgttgtgcgggttaatacaacaaactgtaacaagtgtac
  1       M  D  L  L  S  G  T  Y  I  F  A  V  L  L  A  C  V  V  F
841 ctggtATGGACTTGTTGTCCGGGACGTACATTTTCGCGGTCCTGCTAGCATGCGTGGTGT
 20    H  S  G  A  Q  E  K  N  Y  T  I  R  E  E  M  P  E  N  V  L
```

Figure 2C-2

```
 901 TCCACTCTGGCGCCCAGGAGAAAAACTACACCATCCGAGAAGAAATGCCAGAAAACGTCC
  40    I  G  D  L  L  K  D  L  N  L  S  L  I  P  N  K  S  L  T  T
 961 TGATAGGCGACTTGTTGAAAGACCTTAACTTGTCGCTGATTCCAAACAAGTCCTTGACAA
  60    A  M  Q  F  K  L  V  Y  K  T  G  D  V  P  L  I  R  I  E  E
1021 CTGCTATGCAGTTCAAGCTAGTGTACAAGACCGGAGATGTGCCACTGATTCGAATTGAAG
  80    D  T  G  E  I  F  T  T  G  A  R  I  D  R  E  K  L  C  A  G
1081 AGGATACTGGTGAGATCTTCACTACTGGCGCTCGCATTGATCGTGAGAAATTATGTGCTG
 100    I  P  R  D  E  H  C  F  Y  E  V  E  V  A  I  L  P  D  E  I
1141 GTATCCCAAGGGATGAGCATTGCTTTTATGAAGTGGAGGTTGCCATTTTGCCGGATGAAA
 120    F  R  L  V  K  I  R  F  L  I  E  D  I  N  D  N  A  P  L  F
1201 TATTTAGACTGGTTAAGATACGTTTTCTGATAGAAGATATAAATGATAATGCACCATTGT
 140    P  A  T  V  I  N  I  S  I  P  E  N  S  A  I  N  S  K  Y  T
1261 TCCCAGCAACAGTTATCAACATATCAATTCCAGAGAACTCGGCTATAAACTCTAAATATA
 160    L  P  A  A  V  D  P  D  V  G  I  N  G  V  Q  N  Y  E  L  I
1321 CTCTCCCAGCGGCTGTTGATCCTGACGTAGGAATAAACGGAGTTCAAAACTACGAACTAA
 180    K  S  Q  N  I  F  G  L  D  V  I  E  T  P  E  G  D  K  M  P
1381 TTAAGAGTCAAAACATTTTTGGCCTCGATGTCATTGAAACACCAGAAGGAGACAAGATGC
 200    Q  L  I  V  Q  K  E  L  D  R  E  E  K  D  T  Y  V  M  K  V
1441 CACAACTGATTGTTCAAAAGGAGTTAGATAGGGAAGAGAAGGATACCTACGTGATGAAAG
 220    K  V  E  D  G  G  F  P  Q  R  S  S  T  A  I  L  Q  V  S  V
1501 TAAAGGTTGAAGATGGTGGCTTTCCTCAAAGATCCAGTACTGCTATTTTGCAAGTGAGTG
 240    T  D  T  N  D  N  H  P  V  F  K  E  T  E  I  E  V  S  I  P
1561 TTACTGATACAAATGACAACCACCCAGTCTTTAAGGAGACAGAGATTGAAGTCAGTATAC
 260    E  N  A  P  V  G  T  S  V  T  Q  L  H  A  T  D  A  D  I  G
1621 CAGAAAATGCTCCTGTAGGCACTTCAGTGACACAGCTCCATGCCACAGATGCTGACATAG
 280    E  N  A  K  I  H  F  S  F  S  N  L  V  S  N  I  A  R  R  L
1681 GTGAAAATGCCAAGATCCACTTCTCTTTCAGCAATCTAGTCTCCAACATTGCCAGGAGAT
 300    F  H  L  N  A  T  T  G  L  I  T  I  K  E  P  L  D  R  E  E
1741 TATTTCACCTCAATGCCACCACTGGACTTATCACAATCAAAGAACCACTGGATAGGGAAG
 320    T  P  N  H  K  L  L  V  L  A  S  D  G  G  L  M  P  A  R  A
1801 AAACACCAAACCACAAGTTACTGGTTTTGGCAAGTGATGGTGGATTGATGCCAGCAAGAG
 340    M  V  L  V  N  V  T  D  V  N  D  N  V  P  S  I  D  I  R  Y
1861 CAATGGTGCTGGTAAATGTTACAGATGTCAATGATAATGTCCCATCCATTGACATAAGAT
 360    I  V  N  P  V  N  D  T  V  V  L  S  E  N  I  P  L  N  T  K
1921 ACATCGTCAATCCTGTCAATGACACAGTTGTTCTTTCAGAAAATATTCCACTCAACACCA
 380    I  A  L  I  T  V  T  D  K  D  A  D  H  N  G  R  V  T  C  F
1981 AAATTGCTCTCATAACTGTGACGGATAAGGATGCGGACCATAATGGCAGGGTGACATGCT
 400    T  D  H  E  I  P  F  R  L  R  P  V  F  S  N  Q  F  L  L  E
2041 TCACAGATCATGAAATCCCTTTCAGATTAAGGCCAGTATTCAGTAATCAGTTCCTCCTGG
 420    T  A  A  Y  L  D  Y  E  S  T  K  E  Y  A  I  K  L  L  A  A
2101 AGACTGCAGCATATCTTGACTATGAGTCCACAAAAGAATATGCCATTAAATTACTGGCTG
```

Figure 2C-3

```
       440    D   A   G   K   P   P   L   N   Q   S   A   M   L   F   I   K   V   K   D   E
      2161 CAGATGCTGGCAAACCTCCTTTGAATCAGTCAGCAATGCTCTTCATCAAAGTGAAAGATG
       460    N   D   N   A   P   V   F   T   Q   S   F   V   T   V   S   I   P   E   N   N
      2221 AAAATGACAATGCTCCAGTTTTCACCCAGTCTTTCGTAACTGTTTCTATTCCTGAGAATA
       480    S   P   G   I   Q   L   T   K   V   S   A   M   D   A   D   S   G   P   N   A
      2281 ACTCTCCTGGCATCCAGTTGACGAAAGTAAGTGCAATGGATGCAGACAGTGGGCCTAATG
       500    K   I   N   Y   L   L   G   P   D   A   P   P   E   F   S   L   D   C   R   T
      2341 CTAAGATCAATTACCTGCTAGGCCCTGATGCTCCACCTGAATTCAGCCTGGATTGTCGTA
       520    G   M   L   T   V   V   K   K   L   D   R   E   K   E   D   K   Y   L   F   T
      2401 CAGGCATGCTGACTGTAGTGAAGAAACTAGATAGAGAAAAAGAGGATAAATATTTATTCA
       540    I   L   A   K   D   N   G   V   P   P   L   T   S   N   V   T   V   F   V   S
      2461 CAATTCTGGCAAAAGATAACGGGGTACCACCCTTAACCAGCAATGTCACAGTCTTTGTAA
       560    I   I   D   Q   N   D   N   S   P   V   F   T   H   N   E   Y   N   F   Y   V
      2521 GCATTATTGATCAGAATGACAATAGCCCAGTTTTCACTCACAATGAATACAACTTCTATG
       580    P   E   N   L   P   R   H   G   T   V   G   L   I   T   V   T   D   P   D   Y
      2581 TCCCAGAAAACCTTCCAAGGCATGGTACAGTAGGACTAATCACTGTAACTGATCCTGATT
       600    G   D   N   S   A   V   T   L   S   I   L   D   E   N   D   D   F   T   I   D
      2641 ATGGAGACAATTCTGCAGTTACGCTCTCCATTTTAGATGAGAATGATGACTTCACCATTG
       620    S   Q   T   G   V   I   R   P   N   I   S   F   D   R   E   K   Q   E   S   Y
      2701 ATTCACAAACTGGTGTCATCCGACCAAATATTTCATTTGATAGAGAAAAACAAGAATCTT
       640    T   F   Y   V   K   A   E   D   G   G   R   V   S   R   S   S   S   A   K   V
      2761 ACACTTTCTATGTAAAGGCTGAGGATGGTGGTAGAGTATCACGTTCTTCAAGTGCCAAAG
       660    T   I   N   V   V   D   V   N   D   N   K   P   V   F   I   V   P   P   S   N
      2821 TAACCATAAATGTGGTTGATGTCAATGACAACAAACCAGTTTTCATTGTCCCTCCTTCCA
       680    C   S   Y   E   L   V   L   P   S   T   N   P   G   T   V   V   F   Q   V   I
      2881 ACTGTTCTTATGAATTGGTTCTACCGTCCACTAATCCAGGCACAGTGGTCTTTCAGGTAA
       700    A   V   D   N   D   T   G   M   N   A   E   V   R   Y   S   I   V   G   G   N
      2941 TTGCTGTTGACAATGACACTGGCATGAATGCAGAGGTTCGTTACAGCATTGTAGGAGGAA
       720    T   R   D   L   F   A   I   D   Q   E   T   G   N   I   T   L   M   E   K   C
      3001 ACACAAGAGATCTGTTTGCAATCGACCAAGAAACAGGCAACATAACATTGATGGAGAAAT
       740    D   V   T   D   L   G   L   H   R   V   L   V   K   A   N   D   L   G   Q   P
      3061 GTGATGTTACAGACCTTGGTTTACACAGAGTGTTGGTCAAAGCTAATGACTTAGGACAGC
       760    D   S   L   F   S   V   V   I   V   N   L   F   V   N   E   S   V   T   N   A
      3121 CTGATTCTCTCTTCAGTGTTGTAATTGTCAATCTGTTCGTGAATGAGTCGGTGACCAATG
       780    T   L   I   N   E   L   V   R   K   S   T   E   A   P   V   T   P   N   T   E
      3181 CTACACTGATTAATGAACTGGTGCGCAAAAGCACTGAAGCACCAGTGACCCCAAATACTG
       800    I   A   D   V   S   S   P   T   S   D   Y   V   K   I   L   V   A   A   V   A
      3241 AGATAGCTGATGTATCCTCACCAACTAGTGACTATGTCAAGATCCTGGTTGCAGCTGTTG
       820    G   T   I   T   V   V   V   V   I   F   I   T   A   V   V   R   C   R   Q   A
      3301 CTGGCACCATAACTGTCGTTGTAGTTATTTTCATCACTGCTGTAGTAAGATGTCGCCAGG
       840    P   H   L   K   A   A   Q   K   N   K   Q   N   S   E   W   A   T   P   N   P
```

Figure 2C-4

```
3361 CACCACACCTTAAGGCTGCTCAGAAAAACAAGCAGAATTCTGAATGGGCTACCCCAAACC
 860    E  N  R  Q  M  I  M  M  K  K  K  K  K  K  K  H  S  P  K
3421 CAGAAAACAGGCAGATGATAATGATGAAGAAAAAGAAAAAGAAGAAGAAGCATTCCCCTA
 880    N  L  L  L  N  F  V  T  I  E  E  T  K  A  D  D  V  D  S  D
3481 AGAACTTGCTGCTTAATTTTGTCACTATTGAAGAAACTAAGGCAGATGATGTTGACAGTG
 900    G  N  R  V  T  L  D  L  P  I  D  L  E  E  Q  T  M  G  K  Y
3541 ATGGAAACAGAGTCACACTAGACCTTCCTATTGATCTAGAAGAGCAAACAATGGGAAAGT
 920    N  W  V  T  T  P  T  T  F  K  P  D  S  P  D  L  A  R  H  Y
3601 ACAATTGGGTAACTACACCTACTACTTTCAAGCCCGACAGCCCTGATTTGGCCCGACACT
 940    K  S  A  S  P  Q  P  A  F  Q  I  Q  P  E  T  P  L  N  S  K
3661 ACAAATCTGCCTCTCCACAGCCTGCCTTCCAAATTCAGCCTGAAACTCCCCTGAATTCGA
 960    H  H  I  I  Q  E  L  P  L  D  N  T  F  V  A  C  D  S  I  S
3721 AGCACCACATCATCCAAGAACTGCCTCTCGATAACACCTTTGTGGCCTGTGACTCTATCT
 980    K  C  S  S  S  S  S  D  P  Y  S  V  S  D  C  G  Y  P  V  T
3781 CCAAGTGTTCCTCAAGCAGTTCAGATCCCTACAGCGTTTCTGACTGTGGCTATCCAGTGA
1000    T  F  E  V  P  V  S  V  H  T  R  P  P  M  K  E  V  V  R  S
3841 CGACCTTCGAGGTACCTGTGTCCGTACACACCAGACCGCCAATGAAGGAGGTTGTGCGAT
1020    C  T  P  M  K  E  S  T  T  M  E  I  W  I  H  P  Q  P  Q  R
3901 CTTGCACCCCCATGAAAGAGTCTACAACTATGGAGATCTGGATTCATCCCCAACCACAGC
1040    K  S  E  G  K  V  A  G  K  S  Q  R  R  V  T  F  H  L  P  E
3961 GGAAATCTGAAGGGAAAGTGGCAGGAAAGTCCCAGCGGCGTGTCACATTTCACCTGCCAG
1060    G  S  Q  E  S  S  S  D  G  G  L  G  D  H  D  A  G  S  L  T
4021 AAGGCTCTCAGGAAAGCAGCAGTGATGGTGGACTGGGAGACCATGATGCAGGCAGCCTTA
1080    S  T  S  H  G  L  P  L  G  Y  P  Q  E  E  Y  F  D  R  A  T
4081 CCAGCACATCTCATGGCCTGCCCCTTGGCTATCCTCAGGAGGAGTACTTTGATCGTGCTA
1100    P  S  N  R  T  E  G  D  G  N  S  D  P  E  S  T  F  I  P  G
4141 CACCCAGCAATCGCACTGAAGGGGATGGCAACTCCGATCCTGAATCTACTTTCATACCTG
1120    L  K  K  A  A  E  I  T  V  Q  P  T  V  E  E  A  S  D  N  C
4201 GACTAAAGAAAGCTGCAGAAATAACTGTTCAACCAACTGTGGAAGAGGCCTCTGACAACT
1140    T  Q  E  C  L  I  Y  G  H  S  D  A  C  W  M  P  A  S  L  D
4261 GCACTCAAGAATGTCTCATCTATGGCCATTCTGATGCCTGCTGGATGCCGGCATCTCTGG
1160    H  S  S  S  Q  A  Q  A  S  A  L  C  H  S  P  P  L  S  Q
4321 ATCATTCCAGCTCTTCGCAAGCACAGGCCTCTGCTCTATGCCACAGCCCACCACTGTCAC
1180    A  S  T  Q  H  H  S  P  R  V  T  Q  T  I  A  L  C  H  S  P
4381 AGGCCTCTACTCAGCACCACAGCCCACGAGTGACACAGACCATTGCTCTCTGCCACAGCC
1200    P  V  T  Q  T  I  A  L  C  H  S  P  P  P  I  Q  V  S  A  L
4441 CTCCAGTGACACAGACCATCGCATTGTGCCACAGCCCACCACCGATACAGGTGTCTGCTC
1220    H  H  S  P  P  L  V  Q  A  T  A  L  H  H  S  P  P  S  A  Q
4501 TCCACCACAGTCCTCCTCTAGTGCAGGCTACTGCACTTCACCACAGCCCACCATCAGCAC
1240    A  S  A  L  C  Y  S  P  P  L  A  Q  A  A  A  I  S  H  S  S
4561 AGGCCTCAGCCCTCTGCTACAGCCCTCCTTTAGCACAGGCTGCTGCAATCAGCCACAGCT
```

Figure 2C-5

```
1260       P  L  P  Q  V  I  A  L  H  R  S  Q  A  Q  S  S  V  S  L  Q
4621    CTCCTCTGCCACAGGTTATTGCCCTCCATCGTAGTCAGGCCCAATCATCAGTCAGTTTGC
1280       Q  G  W  V  Q  G  A  D  G  L  C  S  V  D  Q  G  V  Q  G  S
4681    AGCAAGGTTGGGTGCAAGGTGCTGATGGGCTATGCTCTGTTGATCAGGGAGTGCAAGGTA
1300       A  T  S  Q  F  Y  T  M  S  E  R  L  H  P  S  D  D  S  I  K
4741    GTGCAACATCTCAGTTTTACACCATGTCTGAAAGACTTCATCCCAGTGATGATTCAATTA
1320       V  I  P  L  T  T  F  T  P  R  Q  Q  A  R  P  S  R  G  D  S
4801    AAGTCATTCCTTTGACAACCTTCACTCCACGCCAACAGGCCAGACCGTCCAGAGGTGATT
1340       P  I  M  E  E  H  P  L  *
4861    CCCCCATTATGGAAGAACATCCCTTGTAAagctaaaatagttacttcaaattttcagaaa
4921    agatgtatatagtcaaaatttaagatacaattccaatgagtattctgattatcagatttg
4981    taaataactatgtaaatagaaacagataccagaataaatctacagctagacccttagtca
5041    atagttaaccaaaaaattgcaatttgtttaattcagaatgtgtatttaaaaagaaaagga
5101    atttaacaatttgcatccccttgtacagtaaggcttatcatgacagagcgcactatttct
5161    gatgtacagtattttttgttgtttttatcatcatgtgcaatattactgatttgtttccat
5221    gctgattgtgtggaaccagtatgtagcaaatggaaagcctagaaatatcttattttctaa
5281    gtttacctttagtttacctaaacttttgttcagataacgttaaaaggtatacgtactcta
5341    gcctttttttgggctttcttttgattttgtttgttgttttcagtttttttgttgttgt
5401    tagtgagtctcccttcaaaatacgcagtaggtagtgtaaatactgcttgtttgtgtctct
5461    ctgctgtcatgttttctaccttattccaatactatattgttgataaaatttgtatataca
5521    ttttcaataaagaatatgtataaactgtacagatctagatctacaacctatttctctact
5581    ctttagtagagttcgagacacagaagtgcaataactgccctaattaagcaactatttgtt
5641    aaaaagggcctctttttactttaatagtttagtgtaaagtacatcagaaataaagctgta
5701    tctgccattttaagcctgtagtccattattacttgggtctttacttctgggaatttgtat
5761    gtaacagcctagaaaattaaaaggaggtggatgcatccaaagcacgagtcacttaaaata
5821    tcgacggtaaactactattttgtagagaaactcaggaagatttaaatgttgatttgacag
5881    ctcaataggctgttaccaaagggtgttcagtaaaaataacaaatacatgtaactgtagat
5941    aaaaccatatactaaatctataagactaagggattttttgttattctagctcaacttactg
6001    aagaaaaccactaataacaacaagaatatcaggaaggaacttttcaagaaatgtaattat
6061    aaatctacatcaaacagaattttaaggaaaaatgcagagggagaaataaggcacatgact
6121    gcttcttgcagtcaacaagaaataccaataacacacacagaacaaaaaccatcaaaatct
6181    catatatgaaataaaatatattcttctaagcaaagaaacagtactattcatagaaaacat
6241    tagttttcttctgttgtctgttatttccttcttgtatcctcttaactggccattatcttg
6301    tatgtgcacattttataaatgtacagaaacatcaccaacttaattttcttccatagcaaa
6361    actgagaaaatacctttgtttcagtataacactaaaccaagagacaattgatgtttaatgg
6421    gggcggttgggtgggggggggagtcaatatctcctattgattaacttagacatagattt
6481    tgtaatgtataacttgatatttaatttatgattaaactgtgtgtaaattttgtaacataa
6541    actgtggtaattgcataatttcattggtgaggatttccactgaatattgagaaagttctt
6601    tttcatgtgcccagcaggttaagtagcgttttcagaatatacattattcccatccattgt
6661    aaagttccttaagtcatatttgactgggcgtgcagaataacttcttaacttttaactatc
6721    agagtttgattaataaaattaattaatgttttttctccttcgtgttgttaatgttccaag
```

Figure 2C-6

```
6781 ggatttggagcatactggttttccaggtgcatgtgaatcccgaaggactgatgatatttg
6841 aatgtttattaaattattatcatacaaatgtgttgatattgtggctattgttgatgttga
6901 aaattttaaacttggggaagattaagaaaagaaccaatagtgacaaaaatcagtgcttcc
6961 agtagattttagaacattctttgcctcaaaaaacctgcaaagatgatgtgagattttttc
7021 ttgtgttttaattattttcacattttctctctgcaaaactttagttttctgatgatctac
7081 acacacacacacacacacgtgcacacacacacacatttaaatgatataaaaagaagag
7141 gttgaaagattattaaataacttatcaggcatctcaatggttactatctatgttagtgaa
7201 aatcaaataggactcaaagttggatatttgggatttttcttctgacagtataatttattg
7261 agttactagggaggttcttaaatcctcatatctggaaacttgtgacgttttgacaccttt
7321 cctatagatgatataggaatgaaccaatacgcttttattacccttctaactctgatttt
7381 ataatcagacttagattgtgtttagaatattaaatgactgggcaccctcttcttggtttt
7441 taccagagaggctttgaatggaagcaggctgagagtagccaaagaggcaaggggtattag
7501 cccagttattctcccctatgccttccttctctttctaagcgtccactaggtctggccttg
7561 gaaacctgttacttctagggcttcagatctgatgatatcttttcatcacattacaagtt
7621 atttctctgactgaatagacagtggtataggttgacacagcacacaagtggctattgtga
7681 tgtatgatgtatgtagtcctacaactgcaaaacgtcttactgaaccaacaatcaaaaaat
7741 ggttctgttttaaaaggattttgtttgatttgaaattaaaacttcaagctgaatgactt
7801 atatgagaataatacgttcaatcaaagtagttattctattttgtgtccatattccattag
7861 attgtgattattaattttctagctatggtattactatatcacacttgtgagtatgtattc
7921 aaatactaagtatcttatatgctacgtgcatacacattcttttcttaaactttacctgtg
7981 ttttaactaatattgtgtcagtgtattaaaaattagcttttacatatgatatctacaatg
8041 taataaatttagagagtaattttgtgtattcttatttacttaacattttacttttaatta
8101 tgtaaatttggttagaaaataataataaatggttagtgctattgtgtaatggtagcagtt
8161 acaaagagcctctgccttcccaaactaatatttatcacacatggtcattaaatgggaaaa
8221 aaatagactaaacaaatcacaaattgttcagttcttaaaatgtaattatgtcacacacac
8281 aaaaaatccttttcaatcctgagaaaattaaaggcgttttactcacatggctatttcaac
8341 attagtttttttgtttgtttcttttcatggtattactgaaggtgtgtatactccctaa
8401 tacacatttgaaaatctacttgtttaggcttttatttatactcttctgatttatattt
8461 tttattataattattatttcttatctttcttcttttatatttttggaaaccaaatttat
8521 agttagtttaggtaaacttttattatgaccattagaaactattttgaatgcttccaact
8581 ggctcaattggccgggaaaacatgggagcaagagaagctgaaatatatttctgcaagaac
8641 ctttctatattatgtgccaattaccacaccagatcaattttatgcagaggccttaaaata
8701 ttcttttcacagtagctttcttacactaaccgtcatgtgcttttagtaaatatgattttta
8761 aaagcagttcaagttgacaacagcagaaacagtaacaaaaaaatctgctcagaaaaatgt
8821 atgtgcacaaataaaaaaattaatggcaattgtttagtgattgtaagtgatacttttta
8881 aagagtaaactgtgtgaaatttatactatccctgcttaaaatattaagatttttatgaaa
8941 tatgtatttatgtttgtattgtgggaagattcctcctctgtgatatcatacagcatctga
9001 aagtgaacagtatcccaaagcagttccaaccatgctttggaagtaagaaggttgactatt
9061 gtatggccaaggatggcagtatgtaatccagaagcaaacttgtattaattgttctatttc
9121 aggttctgtattgcatgttttcttattaatatatattaataaaagttatgagaaat
```

Figure 2D. The cDNA (SEQ ID NO:8) and amino acid sequence (SEQ ID NO:9) of 109P1D4 v.4. The start methionine is underlined. The open reading frame extends from nucleic acid 846-4859 including the stop codon.

```
   1 ctggtggtccagtacctccaaagatatggaatacactcctgaaatatcctgaaaacttttt
  61 ttttttcagaatcctttaataagcagttatgtcaatctgaaagttgcttacttgtacttt
 121 atattaatagctattcttgttttcttatccaaagaaaaatcctctaatccccttttcac
 181 atgatagttgttaccatgtttaggcattagtcacatcaacccctctcctctcccaaactt
 241 ctcttcttcaaatcaaactttattagtccctcctttataatgattccttgcctcgtttta
 301 tccagatcaatttttttcactttgatgcccagagctgaagaaatggactactgtataaa
 361 ttattcattgccaagagaataattgcattttaaacccatattataacaaagaataatgat
 421 tatattttgtgatttgtaacaaatacccttattttcccttaactattgaattaaatatt
 481 ttaattatttgtattctcttttaactatcttggtatattaaagtattatcttttatatt
 541 tatcaatggtggacacttttataggtactctgtgtcattttgatactgtaggtatctta
 601 tttcatttatctttattcttaatgtacgaattcataatatttgattcagaacaaatttat
 661 cactaattaacagagtgtcaattatgctaacatctcatttactgattttaatttaaaaca
 721 gttttgttaacatgcatgtttaggggttggcttcttaataatttcttcttcctcttctct
 781 ctctcctcttcttttggtcagtgttgtgcgggttaatacaacaaactgtaacaagtgtac
```

```
   1       M  D  L  L  S  G  T  Y  I  F  A  V  L  L  A  C  V  V  F
 841 ctggtATGGACTTGTTGTCCGGGACGTACATTTTCGCGGTCCTGCTAGCATGCGTGGTGT
  20   H  S  G  A  Q  E  K  N  Y  T  I  R  E  E  M  P  E  N  V  L
 901 TCCACTCTGGCGCCCAGGAGAAAAACTACACCATCCGAGAAGAAATGCCAGAAAACGTCC
  40   I  G  D  L  L  K  D  L  N  L  S  L  I  P  N  K  S  L  T  T
 961 TGATAGGCGACTTGTTGAAAGACCTTAACTTGTCGCTGATTCCAAACAAGTCCTTGACAA
  60   A  M  Q  F  K  L  V  Y  K  T  G  D  V  P  L  I  R  I  E  E
1021 CTGCTATGCAGTTCAAGCTAGTGTACAAGACCGGAGATGTGCCACTGATTCGAATTGAAG
  80   D  T  G  E  I  F  T  T  G  A  R  I  D  R  E  K  L  C  A  G
1081 AGGATACTGGTGAGATCTTCACTACTGGCGCTCGCATTGATCGTGAGAAATTATGTGCTG
 100   I  P  R  D  E  H  C  F  Y  E  V  E  V  A  I  L  P  D  E  I
1141 GTATCCCAAGGGATGAGCATTGCTTTTATGAAGTGGAGGTTGCCATTTTGCCGGATGAAA
 120   F  R  L  V  K  I  R  F  L  I  E  D  I  N  D  N  A  P  L  F
1201 TATTTAGACTGGTTAAGATACGTTTTCTGATAGAAGATATAAATGATAATGCACCATTGT
 140   P  A  T  V  I  N  I  S  I  P  E  N  S  A  I  N  S  K  Y  T
1261 TCCCAGCAACAGTTATCAACATATCAATTCCAGAGAACTCGGCTATAAACTCTAAATATA
 160   L  P  A  A  V  D  P  D  V  G  I  N  G  V  Q  N  Y  E  L  I
1321 CTCTCCCAGCGGCTGTTGATCCTGACGTAGGAATAAACGGAGTTCAAAACTACGAACTAA
 180   K  S  Q  N  I  F  G  L  D  V  I  E  T  P  E  G  D  K  M  P
1381 TTAAGAGTCAAAACATTTTTGGCCTCGATGTCATTGAAACACCAGAAGGAGACAAGATGC
 200   Q  L  I  V  Q  K  E  L  D  R  E  E  K  D  T  Y  V  M  K  V
1441 CACAACTGATTGTTCAAAAGGAGTTAGATAGGGAAGAGAAGGATACCTACGTGATGAAAG
 220   K  V  E  D  G  G  F  P  Q  R  S  S  T  A  I  L  Q  V  S  V
1501 TAAAGGTTGAAGATGGTGGCTTTCCTCAAAGATCCAGTACTGCTATTTTGCAAGTGAGTG
 240   T  D  T  N  D  N  H  P  V  F  K  E  T  E  I  E  V  S  I  P
1561 TTACTGATACAAATGACAACCACCCAGTCTTTAAGGAGACAGAGATTGAAGTCAGTATAC
```

Figure 2D-2

```
 260     E  N  A  P  V  G  T  S  V  T  Q  L  H  A  T  D  A  D  I  G
1621 CAGAAAATGCTCCTGTAGGCACTTCAGTGACACAGCTCCATGCCACAGATGCTGACATAG
 280     E  N  A  K  I  H  F  S  F  S  N  L  V  S  N  I  A  R  R  L
1681 GTGAAAATGCCAAGATCCACTTCTCTTTCAGCAATCTAGTCTCCAACATTGCCAGGAGAT
 300     F  H  L  N  A  T  T  G  L  I  T  I  K  E  P  L  D  R  E  E
1741 TATTTCACCTCAATGCCACCACTGGACTTATCACAATCAAAGAACCACTGGATAGGGAAG
 320     T  P  N  H  K  L  L  V  L  A  S  D  G  G  L  M  P  A  R  A
1801 AAACACCAAACCACAAGTTACTGGTTTTGGCAAGTGATGGTGGATTGATGCCAGCAAGAG
 340     M  V  L  V  N  V  T  D  V  N  D  N  V  P  S  I  D  I  R  Y
1861 CAATGGTGCTGGTAAATGTTACAGATGTCAATGATAATGTCCCATCCATTGACATAAGAT
 360     I  V  N  P  V  N  D  T  V  V  L  S  E  N  I  P  L  N  T  K
1921 ACATCGTCAATCCTGTCAATGACACAGTTGTTCTTTCAGAAAATATTCCACTCAACACCA
 380     I  A  L  I  T  V  T  D  K  D  A  D  H  N  G  R  V  T  C  F
1981 AAATTGCTCTCATAACTGTGACGGATAAGGATGCGGACCATAATGGCAGGGTGACATGCT
 400     T  D  H  E  I  P  F  R  L  R  P  V  F  S  N  Q  F  L  L  E
2041 TCACAGATCATGAAATCCCTTTCAGATTAAGGCCAGTATTCAGTAATCAGTTCCTCCTGG
 420     T  A  A  Y  L  D  Y  E  S  T  K  E  Y  A  I  K  L  L  A  A
2101 AGACTGCAGCATATCTTGACTATGAGTCCACAAAAGAATATGCCATTAAATTACTGGCTG
 440     D  A  G  K  P  P  L  N  Q  S  A  M  L  F  I  K  V  K  D  E
2161 CAGATGCTGGCAAACCTCCTTTGAATCAGTCAGCAATGCTCTTCATCAAAGTGAAAGATG
 460     N  D  N  A  P  V  F  T  Q  S  F  V  T  V  S  I  P  E  N  N
2221 AAAATGACAATGCTCCAGTTTTCACCCAGTCTTTCGTAACTGTTTCTATTCCTGAGAATA
 480     S  P  G  I  Q  L  T  K  V  S  A  M  D  A  D  S  G  P  N  A
2281 ACTCTCCTGGCATCCAGTTGACGAAAGTAAGTGCAATGGATGCAGACAGTGGGCCTAATG
 500     K  I  N  Y  L  L  G  P  D  A  P  P  E  F  S  L  D  C  R  T
2341 CTAAGATCAATTACCTGCTAGGCCCTGATGCTCCACCTGAATTCAGCCTGGATTGTCGTA
 520     G  M  L  T  V  V  K  K  L  D  R  E  K  E  D  K  Y  L  F  T
2401 CAGGCATGCTGACTGTAGTGAAGAAACTAGATAGAGAAAAAGAGGATAAATATTTATTCA
 540     I  L  A  K  D  N  G  V  P  P  L  T  S  N  V  T  V  F  V  S
2461 CAATTCTGGCAAAAGATAACGGGGTACCACCCTTAACCAGCAATGTCACAGTCTTTGTAA
 560     I  I  D  Q  N  D  N  S  P  V  F  T  H  N  E  Y  N  F  Y  V
2521 GCATTATTGATCAGAATGACAATAGCCCAGTTTTCACTCACAATGAATACAACTTCTATG
 580     P  E  N  L  P  R  H  G  T  V  G  L  I  T  V  T  D  P  D  Y
2581 TCCCAGAAAACCTTCCAAGGCATGGTACAGTAGGACTAATCACTGTAACTGATCCTGATT
 600     G  D  N  S  A  V  T  L  S  I  L  D  E  N  D  D  F  T  I  D
2641 ATGGAGACAATTCTGCAGTTACGCTCTCCATTTTAGATGAGAATGATGACTTCACCATTG
 620     S  Q  T  G  V  I  R  P  N  I  S  F  D  R  E  K  Q  E  S  Y
2701 ATTCACAAACTGGTGTCATCCGACCAAATATTTCATTTGATAGAGAAAAACAAGAATCTT
 640     T  F  Y  V  K  A  E  D  G  G  R  V  S  R  S  S  S  A  K  V
2761 ACACTTTCTATGTAAAGGCTGAGGATGGTGGTAGAGTATCACGTTCTTCAAGTGCCAAAG
 660     T  I  N  V  V  D  V  N  D  N  K  P  V  F  I  V  P  P  S  N
```

Figure 2D-3

```
2821 TAACCATAAATGTGGTTGATGTCAATGACAACAAACCAGTTTTCATTGTCCCTCCTTCCA
 680   C  S  Y  E  L  V  L  P  S  T  N  P  G  T  V  V  F  Q  V  I
2881 ACTGTTCTTATGAATTGGTTCTACCGTCCACTAATCCAGGCACAGTGGTCTTTCAGGTAA
 700   A  V  D  N  D  T  G  M  N  A  E  V  R  Y  S  I  V  G  G  N
2941 TTGCTGTTGACAATGACACTGGCATGAATGCAGAGGTTCGTTACAGCATTGTAGGAGGAA
 720   T  R  D  L  F  A  I  D  Q  E  T  G  N  I  T  L  M  E  K  C
3001 ACACAAGAGATCTGTTTGCAATCGACCAAGAAACAGGCAACATAACATTGATGGAGAAAT
 740   D  V  T  D  L  G  L  H  R  V  L  V  K  A  N  D  L  G  Q  P
3061 GTGATGTTACAGACCTTGGTTTACACAGAGTGTTGGTCAAAGCTAATGACTTAGGACAGC
 760   D  S  L  F  S  V  V  I  V  N  L  F  V  N  E  S  V  T  N  A
3121 CTGATTCTCTCTTCAGTGTTGTAATTGTCAATCTGTTCGTGAATGAGTCGGTGACCAATG
 780   T  L  I  N  E  L  V  R  K  S  T  E  A  P  V  T  P  N  T  E
3181 CTACACTGATTAATGAACTGGTGCGCAAAAGCACTGAAGCACCAGTGACCCCAAATACTG
 800   I  A  D  V  S  S  P  T  S  D  Y  V  K  I  L  V  A  A  V  A
3241 AGATAGCTGATGTATCCTCACCAACTAGTGACTATGTCAAGATCCTGGTTGCAGCTGTTG
 820   G  T  I  T  V  V  V  I  F  I  T  A  V  V  R  C  R  Q  A
3301 CTGGCACCATAACTGTCGTTGTAGTTATTTTCATCACTGCTGTAGTAAGATGTCGCCAGG
 840   P  H  L  K  A  A  Q  K  N  K  Q  N  S  E  W  A  T  P  N  P
3361 CACCACACCTTAAGGCTGCTCAGAAAAACAAGCAGAATTCTGAATGGGCTACCCCAAACC
 860   E  N  R  Q  M  I  M  M  K  K  K  K  K  K  K  H  S  P  K
3421 CAGAAAACAGGCAGATGATAATGATGAAGAAAAAGAAAAAGAAGAAGAAGCATTCCCCTA
 880   N  L  L  N  F  V  T  I  E  E  T  K  A  D  D  V  D  S  D
3481 AGAACTTGCTGCTTAATTTTGTCACTATTGAAGAAACTAAGGCAGATGATGTTGACAGTG
 900   G  N  R  V  T  L  D  L  P  I  D  L  E  E  Q  T  M  G  K  Y
3541 ATGGAAACAGAGTCACACTAGACCTTCCTATTGATCTAGAAGAGCAAACAATGGGAAAGT
 920   N  W  V  T  T  P  T  T  F  K  P  D  S  P  D  L  A  R  H  Y
3601 ACAATTGGGTAACTACACCTACTACTTTCAAGCCCGACAGCCCTGATTTGGCCCGACACT
 940   K  S  A  S  P  Q  P  A  F  Q  I  Q  P  E  T  P  L  N  S  K
3661 ACAAATCTGCCTCTCCACAGCCTGCCTTCCAAATTCAGCCTGAAACTCCCCTGAATTCGA
 960   H  H  I  I  Q  E  L  P  L  D  N  T  F  V  A  C  D  S  I  S
3721 AGCACCACATCATCCAAGAACTGCCTCTCGATAACACCTTTGTGGCCTGTGACTCTATCT
 980   K  C  S  S  S  S  D  P  Y  S  V  S  D  C  G  Y  P  V  T
3781 CCAAGTGTTCCTCAAGCAGTTCAGATCCCTACAGCGTTTCTGACTGTGGCTATCCAGTGA
1000   T  F  E  V  P  V  S  V  H  T  R  P  P  M  K  E  V  V  R  S
3841 CGACCTTCGAGGTACCTGTGTCCGTACACACCAGACCGCCAATGAAGGAGGTTGTGCGAT
1020   C  T  P  M  K  E  S  T  T  M  E  I  W  I  H  P  Q  P  Q  S
3901 CTTGCACCCCCATGAAAGAGTCTACAACTATGGAGATCTGGATTCATCCCCAACCACAGT
1040   Q  R  R  V  T  F  H  L  P  E  G  S  Q  E  S  S  S  D  G  G
3961 CCCAGCGGCGTGTCACATTTCACCTGCCAGAAGGCTCTCAGGAAAGCAGCAGTGATGGTG
1060   L  G  D  H  D  A  G  S  L  T  S  T  S  H  G  L  P  L  G  Y
4021 GACTGGGAGACCATGATGCAGGCAGCCTTACCAGCACATCTCATGGCCTGCCCCTTGGCT
```

Figure 2D-4

```
1080       P  Q  E  E  Y  F  D  R  A  T  P  S  N  R  T  E  G  D  G  N
4081 ATCCTCAGGAGGAGTACTTTGATCGTGCTACACCCAGCAATCGCACTGAAGGGGATGGCA
1100       S  D  P  E  S  T  F  I  P  G  L  K  K  A  A  E  I  T  V  Q
4141 ACTCCGATCCTGAATCTACTTTCATACCTGGACTAAAGAAAGCTGCAGAAATAACTGTTC
1120       P  T  V  E  E  A  S  D  N  C  T  Q  E  C  L  I  Y  G  H  S
4201 AACCAACTGTGGAAGAGGCCTCTGACAACTGCACTCAAGAATGTCTCATCTATGGCCATT
1140       D  A  C  W  M  P  A  S  L  D  H  S  S  S  Q  A  Q  A  S
4261 CTGATGCCTGCTGGATGCCGGCATCTCTGGATCATTCCAGCTCTTCGCAAGCACAGGCCT
1160       A  L  C  H  S  P  P  L  S  Q  A  S  T  Q  H  S  P  R  V
4321 CTGCTCTATGCCACAGCCCACCACTGTCACAGGCCTCTACTCAGCACCACAGCCCACGAG
1180       T  Q  T  I  A  L  C  H  S  P  P  V  T  Q  T  I  A  L  C  H
4381 TGACACAGACCATTGCTCTCTGCCACAGCCCTCCAGTGACACAGACCATCGCATTGTGCC
1200       S  P  P  P  I  Q  V  S  A  L  H  H  S  P  P  L  V  Q  A  T
4441 ACAGCCCACCACCGATACAGGTGTCTGCTCTCCACCACAGTCCTCCTCTAGTGCAGGCTA
1220       A  L  H  H  S  P  P  S  A  Q  A  S  A  L  C  Y  S  P  P  L
4501 CTGCACTTCACCACAGCCCACCATCAGCACAGGCCTCAGCCCTCTGCTACAGCCCTCCTT
1240       A  Q  A  A  A  I  S  H  S  S  P  L  P  Q  V  I  A  L  H  R
4561 TAGCACAGGCTGCTGCAATCAGCCACAGCTCTCCTCTGCCACAGGTTATTGCCCTCCATC
1260       S  Q  A  Q  S  S  V  S  L  Q  Q  G  W  V  Q  G  A  D  G  L
4621 GTAGTCAGGCCCAATCATCAGTCAGTTTGCAGCAAGGTTGGGTGCAAGGTGCTGATGGGC
1280       C  S  V  D  Q  G  V  Q  G  S  A  T  S  Q  F  Y  T  M  S  E
4681 TATGCTCTGTTGATCAGGGAGTGCAAGGTAGTGCAACATCTCAGTTTTACACCATGTCTG
1300       R  L  H  P  S  D  D  S  I  K  V  I  P  L  T  T  F  T  P  R
4741 AAAGACTTCATCCCAGTGATGATTCAATTAAAGTCATTCCTTTGACAACCTTCACTCCAC
1320       Q  Q  A  R  P  S  R  G  D  S  P  I  M  E  E  H  P  L  *
4801 GCCAACAGGCCAGACCGTCCAGAGGTGATTCCCCCATTATGGAAGAACATCCCTTGTAAa
4861 gctaaaatagttacttcaaattttcagaaaagatgtatatagtcaaaatttaagatacaa
4921 ttccaatgagtattctgattatcagatttgtaaataactatgtaaatagaaacagatacc
4981 agaataaatctacagctagacccttagtcaatagttaaccaaaaaattgcaatttgttta
5041 attcagaatgtgtatttaaaaagaaaaggaatttaacaatttgcatccccttgtacagta
5101 aggcttatcatgacagagcgcactatttctgatgtacagtatttttgttgtttttatca
5161 tcatgtgcaatattactgatttgtttccatgctgattgtgtggaaccagtatgtagcaaa
5221 tggaaagcctagaaatatcttatttctaagtttacctttagtttacctaaacttttgtt
5281 cagataacgttaaaaggtatacgtactctagcctttttttgggctttcttttttgattttt
5341 gtttgttgttttcagttttttttgttgttgttagtgagtctcccttcaaaatacgcagtag
5401 gtagtgtaaatactgcttgtttgtgtctctctgctgtcatgttttctaccttattccaat
5461 actatattgttgataaaatttgtatatacattttcaataaagaatatgtataaactgtac
5521 agatctagatctacaacctatttctctactctttagtagagttcgagacacagaagtgca
5581 ataactgccctaattaagcaactatttgttaaaaagggcctcttttttactttaatagttt
5641 agtgtaaagtacatcagaaataaagctgtatctgccatttttaagcctgtagtccattatt
5701 acttgggtctttacttctgggaatttgtatgtaacagcctagaaaattaaaaggaggtgg
```

Figure 2D-5

```
5761 atgcatccaaagcacgagtcacttaaaatatcgacggtaaactactattttgtagagaaa
5821 ctcaggaagatttaaatgttgatttgacagctcaataggctgttaccaaagggtgttcag
5881 taaaaataacaaatacatgtaactgtagataaaaccatatactaaatctataagactaag
5941 ggattttgttattctagctcaacttactgaagaaaaccactaataacaacaagaatatc
6001 aggaaggaacttttcaagaaatgtaattataaatctacatcaaacagaattttaaggaaa
6061 aatgcagagggagaaataaggcacatgactgcttcttgcagtcaacaagaaataccaata
6121 acacacacagaacaaaaccatcaaaatctcatatatgaaataaaatatattcttctaag
6181 caaagaaacagtactattcatagaaacattagttttcttctgttgtctgttatttcctt
6241 cttgtatcctcttaactggccattatcttgtatgtgcacattttataaatgtacagaaac
6301 atcaccaacttaattttcttccatagcaaaactgagaaaataccttgtttcagtataaca
6361 ctaaaccaagagacaattgatgtttaatggggcggttgggtggggggggagtcaata
6421 tctcctattgattaacttagacatagattttgtaatgtataacttgatatttaatttatg
6481 attaaactgtgtgtaaattttgtaacataaactgtggtaattgcataatttcattggtga
6541 ggatttccactgaatattgagaaagtttcttttcatgtgcccagcaggttaagtagcgtt
6601 ttcagaatatacattattcccatccattgtaaagttccttaagtcatatttgactgggcg
6661 tgcagaataacttcttaacttttaactatcagagtttgattaataaaattaattaatgtt
6721 ttttctccttcgtgttgttaatgttccaagggatttggagcatactggttttccaggtgc
6781 atgtgaatcccgaaggactgatgatatttgaatgtttattaaattattatcatacaaatg
6841 tgttgatattgtggctattgttgatgttgaaaattttaaacttggggaagattaagaaaa
6901 gaaccaatagtgacaaaaatcagtgcttccagtagattttagaacattctttgcctcaaa
6961 aaacctgcaaagatgatgtgagatttttcttgtgttttaattattttcacattttctct
7021 ctgcaaaactttagttttctgatgatctacacacacacacacacacacgtgcacacac
7081 acacacatttaaatgatataaaaagaagaggttgaaagattattaaataacttatcaggc
7141 atctcaatggttactatctatgttagtgaaaatcaaataggactcaaagttggatatttg
7201 ggattttcttctgacagtataatttattgagttactagggaggttcttaaatcctcata
7261 tctggaaacttgtgacgttttgacacctttcctatagatgatataggaatgaaccaatac
7321 gcttttattccccttttctaactctgattttataatcagacttagattgtgtttagaatat
7381 taaatgactgggcaccctcttcttggttttaccagagaggctttgaatggaagcaggct
7441 gagagtagccaaagaggcaaggggtattagcccagttattctcccctatgccttccttct
7501 ctttctaagcgtccactaggtctggccttggaaacctgttacttctagggcttcagatct
7561 gatgatatcttttcatcacattacaagttatttctctgactgaatagacagtggtatag
7621 gttgacacagcacacaagtggctattgtgatgtatgatgtatgtagtcctacaactgcaa
7681 aacgtcttactgaaccaacaatcaaaaaatggttctgttttaaaaaggattttgtttgat
7741 ttgaaattaaaacttcaagctgaatgacttatatgagaataatacgttcaatcaaagtag
7801 ttattctattttgtgtccatattccattagattgtgattattaattttctagctatggta
7861 ttactatatcacacttgtgagtatgtattcaaatactaagtatcttatatgctacgtgca
7921 tacacattcttttcttaaactttacctgtgttttaactaatattgtgtcagtgtattaaa
7981 aattagcttttacatatgatatctacaatgtaataaatttagagagtaattttgtgtatt
8041 cttatttacttaacatttttacttttaattatgtaaatttggttagaaaataataataaat
8101 ggttagtgctattgtgtaatggtagcagttacaaagagcctctgccttcccaaactaata
8161 tttatcacacatggtcattaaatgggaaaaaaatagactaaacaaatcacaaattgttca
```

Figure 2D-6

```
8221 gttcttaaaatgtaattatgtcacacacacaaaaaatccttttcaatcctgagaaaatta
8281 aaggcgttttactcacatggctatttcaacattagttttttttgtttgtttcttttttcat
8341 ggtattactgaaggtgtgtatactccctaatacacatttatgaaaatctacttgtttagg
8401 cttttatttatactcttctgatttatattttttattataattattatttcttatctttct
8461 tcttttatatttttggaaaccaaatttatagttagtttaggtaaacttttttattatgac
8521 cattagaaactattttgaatgcttccaactggctcaattggccgggaaaacatgggagca
8581 agagaagctgaaatatatttctgcaagaaccttctatattatgtgccaattaccacacc
8641 agatcaattttatgcagaggccttaaaatattctttcacagtagctttcttacactaacc
8701 gtcatgtgcttttagtaaatatgatttttaaaagcagttcaagttgacaacagcagaaac
8761 agtaacaaaaaaatctgctcagaaaatgtatgtgcacaaataaaaaaaattaatggcaa
8821 ttgtttagtgattgtaagtgatacttttaaagagtaaactgtgtgaaatttatactatc
8881 cctgcttaaaatattaagattttatgaaatatgtatttatgtttgtattgtgggaagat
8941 tcctcctctgtgatatcatacagcatctgaaagtgaacagtatcccaaagcagttccaac
9001 catgctttggaagtaagaaggttgactattgtatggccaaggatggcagtatgtaatcca
9061 gaagcaaacttgtattaattgttctatttcaggttctgtattgcatgttttcttattaat
9121 atatattaataaaagttatgagaaat
```

Figure 2E. The cDNA (SEQ ID NO:10) and amino acid sequence (SEQ ID NO:11) of 109P1D4 v.5. The start methionine is underlined. The open reading frame extends from nucleic acid 846-4778 including the stop codon.

```
   1 ctggtggtccagtacctccaaagatatggaatacactcctgaaatatcctgaaaactttt
  61 tttttcagaatcctttaataagcagttatgtcaatctgaaagttgcttacttgtactt
 121 atattaatagctattcttgttttcttatccaaagaaaaatcctctaatccccttttcac
 181 atgatagttgttaccatgtttaggcattagtcacatcaacccctctcctctcccaaactt
 241 ctcttcttcaaatcaaactttattagtccctccttataatgattccttgcctcgtttta
 301 tccagatcaattttttttcactttgatgcccagagctgaagaaatggactactgtataaa
 361 ttattcattgccaagagaataattgcattttaaacccatattataacaaagaataatgat
 421 tatattttgtgatttgtaacaaataccctttattttcccttaactattgaattaaatatt
 481 ttaattatttgtattctctttaactatcttggtatattaaagtattatctttatatatt
 541 tatcaatggtggacacttttataggtactctgtgtcatttttgatactgtaggtatctta
 601 tttcatttatctttattcttaatgtacgaattcataatatttgattcagaacaaatttat
 661 cactaattaacagagtgtcaattatgctaacatctcatttactgattttaatttaaaaca
 721 gttttgttaacatgcatgtttagggttggcttcttaataatttcttcttcctcttctct
 781 ctctcctcttcttttggtcagtgttgtgcgggttaatacaacaaactgtaacaagtgtac
   1      M  D  L  L  S  G  T  Y  I  F  A  V  L  L  A  C  V  V  F
 841 ctggtATGGACTTGTTGTCCGGGACGTACATTTTCGCGGTCCTGCTAGCATGCGTGGTGT
  20  H  S  G  A  Q  E  K  N  Y  T  I  R  E  E  M  P  E  N  V  L
 901 TCCACTCTGGCGCCCAGGAGAAAAACTACACCATCCGAGAAGAAATGCCAGAAAACGTCC
  40  I  G  D  L  L  K  D  L  N  L  S  L  I  P  N  K  S  L  T  T
 961 TGATAGGCGACTTGTTGAAAGACCTTAACTTGTCGCTGATTCCAAACAAGTCCTTGACAA
  60  A  M  Q  F  K  L  V  Y  K  T  G  D  V  P  L  I  R  I  E  E
1021 CTGCTATGCAGTTCAAGCTAGTGTACAAGACCGGAGATGTGCCACTGATTCGAATTGAAG
```

Figure 2E-2

```
 80     D  T  G  E  I  F  T  T  G  A  R  I  D  R  E  K  L  C  A  G
1081 AGGATACTGGTGAGATCTTCACTACTGGCGCTCGCATTGATCGTGAGAAATTATGTGCTG
100     I  P  R  D  E  H  C  F  Y  E  V  E  V  A  I  L  P  D  E  I
1141 GTATCCCAAGGGATGAGCATTGCTTTTATGAAGTGGAGGTTGCCATTTTGCCGGATGAAA
120     F  R  L  V  K  I  R  F  L  I  E  D  I  N  D  N  A  P  L  F
1201 TATTTAGACTGGTTAAGATACGTTTTCTGATAGAAGATATAAATGATAATGCACCATTGT
140     P  A  T  V  I  N  I  S  I  P  E  N  S  A  I  N  S  K  Y  T
1261 TCCCAGCAACAGTTATCAACATATCAATTCCAGAGAACTCGGCTATAAACTCTAAATATA
160     L  P  A  A  V  D  P  D  V  G  I  N  G  V  Q  N  Y  E  L  I
1321 CTCTCCCAGCGGCTGTTGATCCTGACGTAGGAATAAACGGAGTTCAAAACTACGAACTAA
180     K  S  Q  N  I  F  G  L  D  V  I  E  T  P  E  G  D  K  M  P
1381 TTAAGAGTCAAAACATTTTTGGCCTCGATGTCATTGAAACACCAGAAGGAGACAAGATGC
200     Q  L  I  V  Q  K  E  L  D  R  E  E  K  D  T  Y  V  M  K  V
1441 CACAACTGATTGTTCAAAAGGAGTTAGATAGGGAAGAGAAGGATACCTACGTGATGAAAG
220     K  V  E  D  G  G  F  P  Q  R  S  S  T  A  I  L  Q  V  S  V
1501 TAAAGGTTGAAGATGGTGGCTTTCCTCAAAGATCCAGTACTGCTATTTTGCAAGTGAGTG
240     T  D  T  N  D  N  H  P  V  F  K  E  T  E  I  E  V  S  I  P
1561 TTACTGATACAAATGACAACCACCCAGTCTTTAAGGAGACAGAGATTGAAGTCAGTATAC
260     E  N  A  P  V  G  T  S  V  T  Q  L  H  A  T  D  A  D  I  G
1621 CAGAAAATGCTCCTGTAGGCACTTCAGTGACACAGCTCCATGCCACAGATGCTGACATAG
280     E  N  A  K  I  H  F  S  F  S  N  L  V  S  N  I  A  R  R  L
1681 GTGAAAATGCCAAGATCCACTTCTCTTTCAGCAATCTAGTCTCCAACATTGCCAGGAGAT
300     F  H  L  N  A  T  T  G  L  I  T  I  K  E  P  L  D  R  E  E
1741 TATTTCACCTCAATGCCACCACTGGACTTATCACAATCAAAGAACCACTGGATAGGGAAG
320     T  P  N  H  K  L  L  V  L  A  S  D  G  G  L  M  P  A  R  A
1801 AAACACCAAACCACAAGTTACTGGTTTTGGCAAGTGATGGTGGATTGATGCCAGCAAGAG
340     M  V  L  V  N  V  T  D  V  N  D  N  V  P  S  I  D  I  R  Y
1861 CAATGGTGCTGGTAAATGTTACAGATGTCAATGATAATGTCCCATCCATTGACATAAGAT
360     I  V  N  P  V  N  D  T  V  V  L  S  E  N  I  P  L  N  T  K
1921 ACATCGTCAATCCTGTCAATGACACAGTTGTTCTTTCAGAAAATATTCCACTCAACACCA
380     I  A  L  I  T  V  T  D  K  D  A  D  H  N  G  R  V  T  C  F
1981 AAATTGCTCTCATAACTGTGACGGATAAGGATGCGGACCATAATGGCAGGGTGACATGCT
400     T  D  H  E  I  P  F  R  L  R  P  V  F  S  N  Q  F  L  L  E
2041 TCACAGATCATGAAATCCCTTTCAGATTAAGGCCAGTATTCAGTAATCAGTTCCTCCTGG
420     T  A  A  Y  L  D  Y  E  S  T  K  E  Y  A  I  K  L  L  A  A
2101 AGACTGCAGCATATCTTGACTATGAGTCCACAAAAGAATATGCCATTAAATTACTGGCTG
440     D  A  G  K  P  P  L  N  Q  S  A  M  L  F  I  K  V  K  D  E
2161 CAGATGCTGGCAAACCTCCTTTGAATCAGTCAGCAATGCTCTTCATCAAAGTGAAAGATG
460     N  D  N  A  P  V  F  T  Q  S  F  V  T  V  S  I  P  E  N  N
2221 AAAATGACAATGCTCCAGTTTTCACCCAGTCTTTCGTAACTGTTTCTATTCCTGAGAATA
480     S  P  G  I  Q  L  T  K  V  S  A  M  D  A  D  S  G  P  N  A
```

Figure 2E-3

```
2281 ACTCTCCTGGCATCCAGTTGACGAAAGTAAGTGCAATGGATGCAGACAGTGGGCCTAATG
 500   K  I  N  Y  L  L  G  P  D  A  P  P  E  F  S  L  D  C  R  T
2341 CTAAGATCAATTACCTGCTAGGCCCTGATGCTCCACCTGAATTCAGCCTGGATTGTCGTA
 520   G  M  L  T  V  V  K  K  L  D  R  E  K  E  D  K  Y  L  F  T
2401 CAGGCATGCTGACTGTAGTGAAGAAACTAGATAGAGAAAAAGAGGATAAATATTTATTCA
 540   I  L  A  K  D  N  G  V  P  P  L  T  S  N  V  T  V  F  V  S
2461 CAATTCTGGCAAAAGATAACGGGGTACCACCCTTAACCAGCAATGTCACAGTCTTTGTAA
 560   I  I  D  Q  N  D  N  S  P  V  F  T  H  N  E  Y  N  F  Y  V
2521 GCATTATTGATCAGAATGACAATAGCCCAGTTTTCACTCACAATGAATACAACTTCTATG
 580   P  E  N  L  P  R  H  G  T  V  G  L  I  T  V  T  D  P  D  Y
2581 TCCCAGAAAACCTTCCAAGGCATGGTACAGTAGGACTAATCACTGTAACTGATCCTGATT
 600   G  D  N  S  A  V  T  L  S  I  L  D  E  N  D  D  F  T  I  D
2641 ATGGAGACAATTCTGCAGTTACGCTCTCCATTTTAGATGAGAATGATGACTTCACCATTG
 620   S  Q  T  G  V  I  R  P  N  I  S  F  D  R  E  K  Q  E  S  Y
2701 ATTCACAAACTGGTGTCATCCGACCAAATATTTCATTTGATAGAGAAAAACAAGAATCTT
 640   T  F  Y  V  K  A  E  D  G  G  R  V  S  R  S  S  S  A  K  V
2761 ACACTTTCTATGTAAAGGCTGAGGATGGTGGTAGAGTATCACGTTCTTCAAGTGCCAAAG
 660   T  I  N  V  V  D  V  N  D  N  K  P  V  F  I  V  P  P  S  N
2821 TAACCATAAATGTGGTTGATGTCAATGACAACAAACCAGTTTTCATTGTCCCTCCTTCCA
 680   C  S  Y  E  L  V  L  P  S  T  N  P  G  T  V  V  F  Q  V  I
2881 ACTGTTCTTATGAATTGGTTCTACCGTCCACTAATCCAGGCACAGTGGTCTTTCAGGTAA
 700   A  V  D  N  D  T  G  M  N  A  E  V  R  Y  S  I  V  G  G  N
2941 TTGCTGTTGACAATGACACTGGCATGAATGCAGAGGTTCGTTACAGCATTGTAGGAGGAA
 720   T  R  D  L  F  A  I  D  Q  E  T  G  N  I  T  L  M  E  K  C
3001 ACACAAGAGATCTGTTTGCAATCGACCAAGAAACAGGCAACATAACATTGATGGAGAAAT
 740   D  V  T  D  L  G  L  H  R  V  L  V  K  A  N  D  L  G  Q  P
3061 GTGATGTTACAGACCTTGGTTTACACAGAGTGTTGGTCAAAGCTAATGACTTAGGACAGC
 760   D  S  L  F  S  V  V  I  V  N  L  F  V  N  E  S  V  T  N  A
3121 CTGATTCTCTCTTCAGTGTTGTAATTGTCAATCTGTTCGTGAATGAGTCGGTGACCAATG
 780   T  L  I  N  E  L  V  R  K  S  T  E  A  P  V  T  P  N  T  E
3181 CTACACTGATTAATGAACTGGTGCGCAAAAGCACTGAAGCACCAGTGACCCCAAATACTG
 800   I  A  D  V  S  S  P  T  S  D  Y  V  K  I  L  V  A  A  V  A
3241 AGATAGCTGATGTATCCTCACCAACTAGTGACTATGTCAAGATCCTGGTTGCAGCTGTTG
 820   G  T  I  T  V  V  V  I  F  I  T  A  V  V  R  C  R  Q  A
3301 CTGGCACCATAACTGTCGTTGTAGTTATTTTCATCACTGCTGTAGTAAGATGTCGCCAGG
 840   P  H  L  K  A  A  Q  K  N  K  Q  N  S  E  W  A  T  P  N  P
3361 CACCACACCTTAAGGCTGCTCAGAAAAACAAGCAGAATTCTGAATGGGCTACCCCAAACC
 860   E  N  R  Q  M  I  M  M  K  K  K  K  K  K  K  H  S  P  K
3421 CAGAAAACAGGCAGATGATAATGATGAAGAAAAAGAAAAAGAAGAAGAAGCATTCCCCTA
 880   N  L  L  N  F  V  T  I  E  E  T  K  A  D  D  V  D  S  D
3481 AGAACTTGCTGCTTAATTTTGTCACTATTGAAGAAACTAAGGCAGATGATGTTGACAGTG
```

Figure 2E-4

```
 900      G  N  R  V  T  L  D  L  P  I  D  L  E  E  Q  T  M  G  K  Y
3541 ATGGAAACAGAGTCACACTAGACCTTCCTATTGATCTAGAAGAGCAAACAATGGGAAAGT
 920      N  W  V  T  T  P  T  T  F  K  P  D  S  P  D  L  A  R  H  Y
3601 ACAATTGGGTAACTACACCTACTACTTTCAAGCCCGACAGCCCTGATTTGGCCCGACACT
 940      K  S  A  S  P  Q  P  A  F  Q  I  Q  P  E  T  P  L  N  S  K
3661 ACAAATCTGCCTCTCCACAGCCTGCCTTCCAAATTCAGCCTGAAACTCCCCTGAATTCGA
 960      H  H  I  I  Q  E  L  P  L  D  N  T  F  V  A  C  D  S  I  S
3721 AGCACCACATCATCCAAGAACTGCCTCTCGATAACACCTTTGTGGCCTGTGACTCTATCT
 980      K  C  S  S  S  S  D  P  Y  S  V  S  D  C  G  Y  P  V  T
3781 CCAAGTGTTCCTCAAGCAGTTCAGATCCCTACAGCGTTTCTGACTGTGGCTATCCAGTGA
1000      T  F  E  V  P  V  S  H  T  R  P  S  Q  R  R  V  T  F  H
3841 CGACCTTCGAGGTACCTGTGTCCGTACACACCAGACCGTCCCAGCGGCGTGTCACATTTC
1020      L  F  E  G  S  Q  E  S  S  S  D  G  L  G  D  H  D  A  G
3901 ACCTGCCAGAAGGCTCTCAGGAAAGCAGCAGTGATGGTGGACTGGGAGACCATGATGCAG
1040      S  L  T  S  T  S  H  G  L  P  L  G  Y  P  Q  E  E  Y  F  D
3961 GCAGCCTTACCAGCACATCTCATGGCCTGCCCCTTGGCTATCCTCAGGAGGAGTACTTTG
1060      R  A  T  P  S  N  R  T  E  G  D  G  N  S  D  P  E  S  T  F
4021 ATCGTGCTACACCCAGCAATCGCACTGAAGGGGATGGCAACTCCGATCCTGAATCTACTT
1080      I  P  G  L  K  K  A  A  E  I  T  V  Q  P  T  V  E  E  A  S
4081 TCATACCTGGACTAAAGAAAGCTGCAGAAATAACTGTTCAACCAACTGTGGAAGAGGCCT
1100      D  N  C  T  Q  E  C  L  I  Y  G  H  S  D  A  C  W  M  P  A
4141 CTGACAACTGCACTCAAGAATGTCTCATCTATGGCCATTCTGATGCCTGCTGGATGCCGG
1120      S  L  D  H  S  S  S  S  Q  A  Q  A  S  A  L  C  H  S  P  P
4201 CATCTCTGGATCATTCCAGCTCTTCGCAAGCACAGGCCTCTGCTCTATGCCACAGCCCAC
1140      L  S  Q  A  S  T  Q  H  H  S  P  R  V  T  Q  T  I  A  L  C
4261 CACTGTCACAGGCCTCTACTCAGCACCACAGCCCACGAGTGACACAGACCATTGCTCTCT
1160      H  S  P  P  V  T  Q  T  I  A  L  C  H  S  P  P  P  I  Q  V
4321 GCCACAGCCCTCCAGTGACACAGACCATCGCATTGTGCCACAGCCCACCACCGATACAGG
1180      S  A  L  H  H  S  P  P  L  V  Q  A  T  A  L  H  H  S  P  P
4381 TGTCTGCTCTCCACCACAGTCCTCCTCTAGTGCAGGCTACTGCACTTCACCACAGCCCAC
1200      S  A  Q  A  S  A  L  C  Y  S  P  P  L  A  Q  A  A  A  I  S
4441 CATCAGCACAGGCCTCAGCCCTCTGCTACAGCCCTCCTTTAGCACAGGCTGCTGCAATCA
1220      H  S  S  P  L  P  Q  V  I  A  L  H  R  S  Q  A  Q  S  S  V
4501 GCCACAGCTCTCCTCTGCCACAGGTTATTGCCCTCCATCGTAGTCAGGCCCAATCATCAG
1240      S  L  Q  Q  G  W  V  Q  G  A  D  G  L  C  S  V  D  Q  G  V
4561 TCAGTTTGCAGCAAGGTTGGGTGCAAGGTGCTGATGGGCTATGCTCTGTTGATCAGGGAG
1260      Q  G  S  A  T  S  Q  F  Y  T  M  S  E  R  L  H  P  S  D  D
4621 TGCAAGGTAGTGCAACATCTCAGTTTTACACCATGTCTGAAAGACTTCATCCCAGTGATG
1280      S  I  K  V  I  P  L  T  T  F  T  P  R  Q  Q  A  R  P  S  R
4681 ATTCAATTAAAGTCATTCCTTTGACAACCTTCACTCCACGCCAACAGGCCAGACCGTCCA
1300      G  D  S  P  I  M  E  E  H  P  L  *
```

Figure 2E-5

```
4741 GAGGTGATTCCCCCATTATGGAAGAACATCCCTTGTAAagctaaaatagttacttcaaat
4801 tttcagaaaagatgtatatagtcaaaatttaagatacaattccaatgagtattctgatta
4861 tcagatttgtaaataactatgtaaatagaaacagataccagaataaatctacagctagac
4921 ccttagtcaatagttaaccaaaaaattgcaatttgtttaattcagaatgtgtatttaaaa
4981 agaaaaggaatttaacaatttgcatcccctcgtacagtaaggcttatcatgacagagcgc
5041 actatttctgatgtacagtattttttgttgttttatcatcatgtgcaatattactgatt
5101 tgtttccatgctgattgtgtggaaccagtatgtagcaaatggaaagcctagaaatatctt
5161 attttctaagtttacctttagtttacctaaacttttgttcagataacgttaaaaggtata
5221 cgtactctagcctttttttgggctttcttttgattttgttgttgttttcagtttttt
5281 tgttgttgttagtgagtctcccttcaaaatacgcagtaggtagtgtaaatactgcttgtt
5341 tgtgtctctctgctgtcatgttttctaccttattccaatactatattgttgataaaattt
5401 gtatatcattttcaataaagaatatgtataaactgtacagatctagatctacaacctat
5461 ttctctactctttagtagagttcgagacacagaagtgcaataactgccctaattaagcaa
5521 ctatttgttaaaaagggcctcttttttactttaatagtttagtgtaaagtacatcagaaat
5581 aaagctgtatctgccattttaagcctgtagtccattattacttgggtctttacttctggg
5641 aatttgtatgtaacagcctagaaaattaaaaggaggtggatgcatccaaagcacgagtca
5701 cttaaaatatcgacggtaaactactattttgtagagaaactcaggaagatttaaatgttg
5761 atttgacagctcaataggctgttaccaaagggtgttcagtaaaaataacaaatacatgta
5821 actgtagataaaaccatatactaaatctataagactaagggattttgttattctagctc
5881 aacttactgaagaaaaccactaataacaacaagaatatcaggaaggaacttttcaagaaa
5941 tgtaattataaatctacatcaaacagaattttaaggaaaaatgcagagggagaaataagg
6001 cacatgactgcttcttgcagtcaacaagaaataccaataacacacacagaacaaaaacca
6061 tcaaaatctcatatatgaaataaaatatattcttctaagcaaagaaacagtactattcat
6121 agaaaacattagttttcttctgttgtctgttatttccttcttgtatcctcttaactggcc
6181 attatcttgtatgtgcacattttataaatgtacagaaacatcaccaacttaattttcttc
6241 catagcaaaactgagaaaataccttgtttcagtataacactaaaccaagagacaattgat
6301 gtttaatggggcggttggggtgggggggggagtcaatatctcctattgattaacttaga
6361 catagattttgtaatgtataacttgatatttaatttatgattaaactgtgtgtaaatttt
6421 gtaacataaactgtggtaattgcataatttcattggtgaggatttccactgaatattgag
6481 aaagtttcttttcatgtgcccagcaggttaagtagcgttttcagaatatacattattccc
6541 atccattgtaaagttccttaagtcatatttgactgggcgtgcagaataacttcttaactt
6601 ttaactatcagagtttgattaataaaattaattaatgttttttctccttcgtgttgttaa
6661 tgttccaagggatttggagcatactggttttccaggtgcatgtgaatcccgaaggactga
6721 tgatatttgaatgtttattaaattattatcatacaaatgtgttgatattgtggctattgt
6781 tgatgttgaaaattttaaacttggggaagattaagaaaagaaccaatagtgacaaaaatc
6841 agtgcttccagtagattttagaacattctttgcctcaaaaaacctgcaaagatgatgtga
6901 gattttttcttgtgttttaattattttcacattttctctctgcaaaactttagttttctg
6961 atgatctacacacacacacacacacacgtgcacacacacacacatttaaatgatataa
7021 aaagaagaggttgaaagattattaaataacttatcaggcatctcaatggttactatctat
7081 gttagtgaaaatcaaataggactcaaagttggatatttgggattttcttctgacagtat
7141 aatttattgagttactagggaggttcttaaatcctcatatctggaaacttgtgacgtttt
```

Figure 2E-6

```
7201 gacacctttcctatagatgatataggaatgaaccaatacgcttttattaccctttctaac
7261 tctgattttataatcagacttagattgtgtttagaatattaaatgactgggcaccctctt
7321 cttggttttaccagagaggctttgaatggaagcaggctgagagtagccaaagaggcaag
7381 gggtattagcccagttattctcccctatgccttccttctctttctaagcgtccactaggt
7441 ctggccttggaaacctgttacttctagggcttcagatctgatgatatcttttcatcaca
7501 ttacaagttatttctctgactgaatagacagtggtataggttgacacagcacacaagtgg
7561 ctattgtgatgtatgatgtatgtagtcctacaactgcaaaacgtcttactgaaccaacaa
7621 tcaaaaaatggttctgttttaaaaaggattttgtttgatttgaaattaaaacttcaagct
7681 gaatgacttatatgagaataatacgttcaatcaaagtagttattctattttgtgtccata
7741 ttccattagattgtgattattaattttctagctatggtattactatatcacacttgtgag
7801 tatgtattcaaatactaagtatcttatatgctacgtgcatacacattcttttcttaaact
7861 ttacctgtgttttaactaatattgtgtcagtgtattaaaaattagcttttacatatgata
7921 tctacaatgtaataaatttagagagtaattttgtgtattcttatttacttaacattttac
7981 ttttaattatgtaaatttggttagaaaataataataaatggttagtgctattgtgtaatg
8041 gtagcagttacaaagagcctctgccttcccaaactaatatttatcacacatggtcattaa
8101 atgggaaaaaatagactaaacaaatcacaaattgttcagttcttaaaatgtaattatgt
8161 cacacacacaaaaaatccttttcaatcctgagaaaattaaaggcgttttactcacatggc
8221 tatttcaacattagttttttttgtttgtttcttttcatggtattactgaaggtgtgtat
8281 actccctaatacacatttatgaaaatctacttgtttaggcttttatttatactcttctga
8341 tttatattttttattataattattatttcttatctttcttcttttatattttttggaaac
8401 caaatttatagttagtttaggtaaacttttttattatgaccattagaaactattttgaatg
8461 cttccaactggctcaattggccgggaaaacatgggagcaagagaagctgaaatatatttc
8521 tgcaagaacctttctatattatgtgccaattaccacaccagatcaattttatgcagaggc
8581 cttaaaatattctttcacagtagctttcttacactaaccgtcatgtgcttttagtaaata
8641 tgattttaaaagcagttcaagttgacaacagcagaaacagtaacaaaaaaatctgctca
8701 gaaaaatgtatgtgcacaaataaaaaaaattaatggcaattgtttagtgattgtaagtga
8761 tacttttaaagagtaaactgtgtgaaatttatactatccctgcttaaaatattaagatt
8821 tttatgaaatatgtatttatgtttgtattgtgggaagattcctcctctgtgatatcatac
8881 agcatctgaaagtgaacagtatcccaaagcagttccaaccatgctttggaagtaagaagg
8941 ttgactattgtatggccaaggatggcagtatgtaatccagaagcaaacttgtattaattg
9001 ttctatttcaggttctgtattgcatgttttcttattaatatatattaataaaagttatga
9061 gaaat
```

Figure 2F. The cDNA (SEQ ID NO:12) and amino acid sequence (SEQ ID NO:13) of 109P1D4 v.6. The start methionine is underlined. The open reading frame extends from nucleic acid 614-3727 including the stop codon.

```
  1 ggcagtcggcgaactgtctgggcggggaggagccgtgagcagtagctgcactcagctgccc
 61 gcgcggcaaagaggaaggcaagccaaacagagtgcgcagagtggcagtgccagcggcgac
121 acaggcagcacaggcagcccgggctgcctgaatagcctcagaaacaacctcagcgactcc
181 ggctgctctgcggactgcgagctgtggcggtagagcccgctacagcagtcgcagtctccg
241 tggagcgggcggaagcctttttttctcccttttcgtttacctcttcattctactctaaaggc
301 atcgttattagagggtgcttaaaaaagtacagatcaactggatggatgaatggatggaaga
```

Figure 2F-2

```
 361 ggatggaatatcttaacaaaacacatttccttaagtaaattcatgcatactccaaataa
 421 aatacagaatgtgaagtatctctgaactgtgctgttgaatatggtagctactagctacat
 481 gaaaatcctgttgtgaataagaaggattccacagatcacataccagagcggttttgcctc
 541 agctgctctcaactttgtaatcttgtgaagaagctgacaagcttggctgattgcagtgca
   1                  M  T  V  G  F  N  S  D  I  S  S  V  V  R  V  N
 601 ctatgaggactgaATGACAGTGGGTTTTAATTCAGATATTTCAAGTGTTGTGCGGGTTAA
  17  T  T  N  C  H  K  C  L  L  S  G  T  Y  I  F  A  V  L  L  V
 661 TACAACAAACTGTCACAAGTGTTTGTTGTCCGGGACGTACATTTTCGCGGTCCTGCTAGT
  37  C  V  V  F  H  S  G  A  Q  E  K  N  Y  I  R  E  E  I  P
 721 ATGCGTGGTGTTCCACTCTGGCGCCCAGGAGAAAAACTACACCATCCGAGAAGAAATTCC
  57  E  N  V  L  I  G  N  L  L  K  D  L  N  L  S  L  I  P  N  K
 781 AGAAAACGTCCTGATAGGCAACTTGTTGAAAGACCTTAACTTGTCGCTGATTCCAAACAA
  77  S  L  T  T  T  M  Q  F  K  L  V  Y  K  T  G  D  V  P  L  I
 841 GTCCTTGACAACTACTATGCAGTTCAAGCTAGTGTACAAGACCGGAGATGTGCCACTGAT
  97  R  I  E  E  D  T  G  E  I  F  T  T  G  A  R  I  D  R  E  K
 901 TCGAATTGAAGAGGATACTGGTGAGATCTTCACTACCGGCGCTCGCATTGATCGTGAGAA
 117  L  C  A  G  I  P  R  D  E  H  C  F  Y  E  V  E  V  A  I  L
 961 ATTATGTGCTGGTATCCCAAGGGATGAGCATTGCTTTTATGAAGTGGAGGTTGCCATTTT
 137  P  D  E  I  F  R  L  V  K  I  R  F  L  I  E  D  I  N  D  N
1021 GCCGGATGAAATATTTAGACTGGTTAAGATACGTTTTCTGATAGAAGATATAAATGATAA
 157  A  P  L  F  P  A  T  V  I  N  I  S  I  P  E  N  S  A  I  N
1081 TGCACCATTGTTCCCAGCAACAGTTATCAACATATCAATTCCAGAGAACTCGGCTATAAA
 177  S  K  Y  T  L  P  A  A  V  D  P  D  V  G  I  N  G  V  Q  N
1141 CTCTAAATATACTCTCCCAGCGGCTGTTGATCCTGACGTAGGCATAAACGGAGTTCAAAA
 197  Y  E  L  I  K  S  Q  N  I  F  G  L  D  V  I  E  T  P  E  G
1201 CTACGAACTAATTAAGAGTCAAAACATTTTTGGCCTCGATGTCATTGAAACACCAGAAGG
 217  D  K  M  P  Q  L  I  V  Q  K  E  L  D  R  E  E  K  D  T  Y
1261 AGACAAGATGCCACAACTGATTGTTCAAAAGGAGTTAGATAGGGAAGAGAAGGATACCTA
 237  V  M  K  V  K  V  E  D  G  G  F  P  Q  R  S  S  T  A  I  L
1321 TGTGATGAAAGTAAAGGTTGAAGATGGTGGCTTTCCTCAAAGATCCAGTACTGCTATTTT
 257  Q  V  S  V  T  D  T  N  D  N  H  P  V  F  K  E  T  E  I  E
1381 GCAAGTAAGTGTTACTGATACAAATGACAACCACCCAGTCTTTAAGGAGACAGAGATTGA
 277  V  S  I  P  E  N  A  P  V  G  T  S  V  T  Q  L  H  A  T  D
1441 AGTCAGTATACCAGAAAATGCTCCTGTAGGCACTTCAGTGACACAGCTCCATGCCACAGA
 297  A  D  I  G  E  N  A  K  I  H  F  S  F  S  N  L  V  S  N  I
1501 TGCTGACATAGGTGAAAATGCCAAGATCCACTTCTCTTTCAGCAATCTAGTCTCCAACAT
 317  A  R  R  L  F  H  L  N  A  T  T  G  L  I  T  I  K  E  P  L
1561 TGCCAGGAGATTATTTCACCTCAATGCCACCACTGGACTTATCACAATCAAAGAACCACT
 337  D  R  E  E  T  P  N  H  K  L  L  V  L  A  S  D  G  G  L  M
1621 GGATAGGGAAGAAACACCAAACCACAAGTTACTGGTTTTGGCAAGTGATGGTGGATTGAT
 357  P  A  R  A  M  V  L  V  N  V  T  D  V  N  D  N  V  P  S  I
```

Figure 2F-3

```
1681 GCCAGCAAGAGCAATGGTGCTGGTAAATGTTACAGATGTCAATGATAATGTCCCATCCAT
 377   D  I  R  Y  I  V  N  P  V  N  D  T  V  V  L  S  E  N  I  P
1741 TGACATAAGATACATCGTCAATCCTGTCAATGACACAGTTGTTCTTTCAGAAAATATTCC
 397   L  N  T  K  I  A  L  I  T  V  T  D  K  D  A  D  H  N  G  R
1801 ACTCAACACCAAAATTGCTCTCATAACTGTGACGGATAAGGATGCGGACCATAATGGCAG
 417   V  T  C  F  T  D  H  E  I  P  F  R  L  R  P  V  F  S  N  Q
1861 GGTGACATGCTTCACAGATCATGAAATTCCTTTCAGATTAAGGCCAGTATTCAGTAATCA
 437   F  L  L  E  N  A  A  Y  L  D  Y  E  S  T  K  E  Y  A  I  K
1921 GTTCCTCCTGGAGAATGCAGCATATCTTGACTATGAGTCCACAAAAGAATATGCCATTAA
 457   L  L  A  A  D  A  G  K  P  P  L  N  Q  S  A  M  L  F  I  K
1981 ATTACTGGCTGCAGATGCTGGCAAACCTCCTTTGAATCAGTCAGCAATGCTCTTCATCAA
 477   V  K  D  E  N  D  N  A  P  V  F  T  Q  S  F  V  T  V  S  I
2041 AGTGAAAGATGAAAATGACAATGCTCCAGTTTTCACCCAGTCTTTCGTAACTGTTTCTAT
 497   P  E  N  N  S  P  G  I  Q  L  M  K  V  S  A  T  D  A  D  S
2101 TCCTGAGAATAACTCTCCTGGCATCCAGTTGATGAAAGTAAGTGCAACGGATGCAGACAG
 517   G  P  N  A  E  I  N  Y  L  L  G  P  D  A  P  P  E  F  S  L
2161 TGGGCCTAATGCTGAGATCAATTACCTGCTAGGCCCTGATGCTCCACCTGAATTCAGCCT
 537   D  R  R  T  G  M  L  T  V  V  K  K  L  D  R  E  K  E  D  K
2221 GGATCGTCGTACAGGCATGCTGACTGTAGTGAAGAAACTAGATAGAGAAAAAGAGGATAA
 557   Y  L  F  T  I  L  A  K  D  N  G  V  P  P  L  T  S  N  V  T
2281 ATATTTATTCACAATTCTGGCAAAAGATAATGGGGTACCACCCTTAACCAGCAATGTCAC
 577   V  F  V  S  I  I  D  Q  N  D  N  S  P  V  F  T  H  N  E  Y
2341 AGTCTTTGTAAGCATTATTGATCAGAATGACAATAGCCCAGTTTTCACTCACAATGAATA
 597   K  F  Y  V  P  E  N  L  P  R  H  G  T  V  G  L  I  T  V  T
2401 CAAATTCTATGTCCCAGAAAACCTTCCAAGGCATGGTACAGTAGGACTAATCACTGTAAC
 617   D  P  D  Y  G  D  N  S  A  V  T  L  S  I  L  D  E  N  D  D
2461 TGATCCTGATTATGGAGACAATTCTGCAGTTACGCTCTCCATTTTAGATGAGAATGATGA
 637   F  T  I  D  S  Q  T  G  V  I  R  P  N  I  S  F  D  R  E  K
2521 CTTCACCATTGATTCACAAACTGGTGTCATCCGACCAAATATTTCATTTGATAGAGAAAA
 657   Q  E  S  Y  T  F  Y  V  K  A  E  D  G  G  R  V  S  R  S  S
2581 ACAAGAATCTTACACTTTCTATGTAAAGGCTGAGGATGGTGGTAGAGTATCACGTTCTTC
 677   S  A  K  V  T  I  N  V  V  D  V  N  D  N  K  P  V  F  I  V
2641 AAGTGCCAAAGTAACCATAAATGTGGTTGATGTCAATGACAACAAACCAGTTTTCATTGT
 697   P  P  Y  N  Y  S  Y  E  L  V  P  S  T  N  P  G  T  V  V
2701 CCCTCCTTACAACTATTCTTATGAATTGGTTCTACCGTCCACTAATCCAGGCACAGTGGT
 717   F  Q  V  I  A  V  D  N  D  T  G  M  N  A  E  V  R  Y  S  I
2761 CTTTCAGGTAATTGCTGTTGACAATGACACTGGCATGAATGCAGAGGTTCGTTACAGCAT
 737   V  G  G  N  T  R  D  L  F  A  I  D  Q  E  T  G  N  I  T  L
2821 TGTAGGAGGAAACACAAGAGATCTGTTTGCAATCGACCAAGAAACAGGCAACATAACATT
 757   M  E  K  C  D  V  T  D  L  G  L  H  R  V  L  V  K  A  N  D
2881 GATGGAGAAATGTGATGTTACAGACCTTGGTTTACACAGAGTGTTGGTCAAAGCTAATGA
```

Figure 2F-4

```
 777  L  G  Q  P  D  S  L  F  S  V  V  I  V  N  L  F  V  N  E  S
2941  CTTAGGACAGCCTGATTCTCTCTTCAGTGTTGTAATTGTCAATCTGTTCGTGAATGAGTC
 797  V  T  N  A  T  L  I  N  E  L  V  R  K  S  I  E  A  P  V  T
3001  AGTGACCAATGCTACACTGATTAATGAACTGGTGCGCAAAAGCATTGAAGCACCAGTGAC
 817  P  N  T  E  I  A  D  V  S  S  P  T  S  D  Y  V  K  I  L  V
3061  CCCAAATACTGAGATAGCTGATGTATCCTCACCAACTAGTGACTATGTCAAGATCCTGGT
 837  A  A  V  A  G  T  I  T  V  V  V  I  F  I  T  A  V  V  R
3121  TGCAGCTGTTGCTGGCACCATAACTGTCGTTGTAGTTATTTTCATCACTGCTGTAGTAAG
 857  C  R  Q  A  P  H  L  K  A  A  Q  K  N  M  Q  N  S  E  W  A
3181  ATGTCGCCAGGCACCACACCTTAAGGCTGCTCAGAAAAACATGCAGAATTCTGAATGGGC
 877  T  P  N  P  E  N  R  Q  M  I  M  M  K  K  K  K  K  K  K  K
3241  TACCCCAAACCCAGAAAACAGGCAGATGATAATGATGAAGAAAAAGAAAAAGAAGAAGAA
 897  H  S  P  K  N  L  L  N  F  V  T  I  E  E  T  K  A  D  D
3301  GCATTCCCCTAAGAACCTGCTGCTTAATTTTGTCACTATTGAAGAAACTAAGGCAGATGA
 917  V  D  S  D  G  N  R  V  T  L  D  L  P  I  D  L  E  E  Q  T
3361  TGTTGACAGTGATGGAAACAGAGTCACACTAGACCTTCCTATTGATCTAGAAGAGCAAAC
 937  M  G  K  Y  N  W  V  T  T  P  T  T  F  K  P  D  S  P  D  L
3421  AATGGGAAAGTACAATTGGGTAACTACACCTACTACTTTCAAGCCTGACAGCCCTGATTT
 957  A  R  H  Y  K  S  A  S  P  Q  P  A  F  Q  I  Q  P  E  T  P
3481  GGCCCGACACTACAAATCTGCCTCTCCACAGCCTGCCTTCCAAATTCAGCCTGAAACTCC
 977  L  N  L  K  H  H  I  I  Q  E  L  P  L  D  N  T  F  V  A  C
3541  CCTGAATTTGAAGCACCACATCATCCAAGAACTGCCTCTCGATAACACCTTTGTGGCCTG
 997  D  S  I  S  K  C  S  S  S  S  S  D  P  Y  S  V  S  D  C  G
3601  TGACTCTATCTCCAAGTGTTCCTCAAGCAGTTCAGATCCCTACAGCGTTTCTGACTGTGG
1017  Y  P  V  T  T  F  E  V  P  V  S  V  H  T  R  P  T  D  S  R
3661  CTATCCAGTGACAACCTTCGAGGTACCTGTGTCCGTACACACCAGACCGACTGATTCCAG
1037  T  *
3721  GACATGAactattgaaatctgcagtgagatgtaactttctaggaacaacaaaattccatt
3781  ccccttccaaaaaatttcaatggattgtgatttcaaaattaggctaagatcattaatttt
3841  gtaatctagatttcccattataaaagcaagcaaaaatcatcttaaaaatgatgtcctagt
3901  gaaccttgtgctttctttagctgtaatctggcaatggaaatttaaaatttatggaagaga
3961  cagtgcagcacaataacagagtactctcatgctgtttctctgtttgctctgaatcaacag
4021  ccatgatgtaatataaggctgtcttggtgtatacacttatggttaatatatcagtcatga
4081  aacatgcaattacttgccctgtctgattgttgaataattaaaacattatcttccaggagt
4141  ttggaagtgagctgaactagccaaactactctctgaaaggtatccagggcaagagacatt
4201  tttaagaccccaaacaaacaaaaaacaaaaccaaaacactctggttcagtgttttgaaaa
4261  tattcactaacataatattgctgagaaaatcatttttattacccaccactctgcttaaaa
4321  gttgagtgggccgggcgcggtggctcacgcctgtaatcccagcactttgggaggccgagg
4381  cgggtggatcacgaggtcaggagattgagaccatcctggctaacacggtgaaacccatc
4441  tccactaaaaatacaaaaaattagcctggcgtggtggcgggcgcctgtagtcccagctac
4501  tcgggaggctgaggcaggagaatagcgtgaacccgggaggcggagcttgcagtgagccga
```

Figure 2F-5

```
4561  gatggcgccactctgcactccagcctgggtgacagagcaagactctgtctcaaaaagaaa
4621  aaaatgttcaatgatagaaaataattttactaggttttatgttgattgtactcatggtg
4681  ttccactccttttaattattaaaaagttattttggggtgggtgtggtggctcacaccgt
4741  aatcccagcactttgggaggccgaggtgggtggatcacctgaggtcaggagttcaagacc
4801  agtntggccaacatggcgaaaccccgtttt
```

Figure 2G. The cDNA (SEQ ID NO:14) and amino acid sequence (SEQ ID NO:15) of 109P1D4 v.7. The start methionine is underlined. The open reading frame extends from nucleic acid 735-3881 including the stop codon.

```
   1  ggtggtccagtacctccaaagatatggaatacactcctgaaatatcctgaaacctttttt
  61  ttttcagaatcctttaataagcagttatgtcaatctgaaagttgcttacttgtactttat
 121  attaatagctattcttgttttcttatccaaagaaaaatcctctaatccccttttcacat
 181  gatagttgttaccatgtttaggcgttagtcacatcaaccctctcctctcccaaacttct
 241  cttcttcaaatcaaactttattagtccctcctttataatgattccttgcctccttttatc
 301  cagatcaatttttttcactttgatgcccagagctgaagaaatggactattgtataaatt
 361  attcattgccaagagaataattgcattttaaacccatgttataacaaagaataatgatta
 421  tattttgtgatttgtaacaaatacccttatttttcccttaactattgaattaaatatttt
 481  aattatttgtattctctttaactatcttggtatattaaagtattatcttttatatattta
 541  tcaatggtggacacttttataggtactctgtgtcattttgatactgtaggtatcttatt
 601  tcatttatctttattcttaatgtacgaattcataatatttgattcagaacagatttatca
 661  ctaattaacagagtgtcaattatgctaacatctcatttactgattttaatttaaaacagt
   1                 M  F  R  V  G  F  L  I  I  S  S  S  S  L  S
 721  ttttgttaacatgcATGTTTAGGGTTGGCTTCTTAATAATTTCTTCTTCCTCTTCTCTCT
  17     P  L  L  V  S  V  V  R  V  N  T  T  N  C  H  K  C  L  L
 781  CTCCTCTTCTTTTGGTCAGTGTTGTGCGGGTTAATACAACAAACTGTCACAAGTGTTTGT
  37     S  G  T  Y  I  F  A  V  L  L  V  C  V  V  F  H  S  G  A  Q
 841  TGTCCGGGACGTACATTTTCGCGGTCCTGCTAGTATGCGTGGTGTTCCACTCTGGCGCCC
  57     E  K  N  Y  T  I  R  E  E  I  P  E  N  V  L  I  G  N  L  L
 901  AGGAGAAAAACTACACCATCCGAGAAGAAATTCCAGAAAACGTCCTGATAGGCAACTTGT
  77     K  D  L  N  L  S  L  I  P  N  K  S  L  T  T  T  M  Q  F  K
 961  TGAAAGACCTTAACTTGTCGCTGATTCCAAACAAGTCCTTGACAACTACTATGCAGTTCA
  97     L  V  Y  K  T  G  D  V  P  L  I  R  I  E  E  D  T  G  E  I
1021  AGCTAGTGTACAAGACCGGAGATGTGCCACTGATTCGAATTGAAGAGGATACTGGTGAGA
 117    F  T  T  G  A  R  I  D  R  E  K  L  C  A  G  I  P  R  D  E
1081  TCTTCACTACCGGCGCTCGCATTGATCGTGAGAAATTATGTGCTGGTATCCCAAGGGATG
 137    H  C  F  Y  E  V  E  V  A  I  L  P  D  E  I  F  R  L  V  K
1141  AGCATTGCTTTTATGAAGTGGAGGTTGCCATTTTGCCGGATGAAATATTTAGACTGGTTA
 157    I  R  F  L  I  E  D  I  N  D  A  P  L  F  P  A  T  V  I
1201  AGATACGTTTTCTGATAGAAGATATAAATGATAATGCACCATTGTTCCCAGCAACAGTTA
 177    N  I  S  I  P  E  N  S  A  I  N  S  K  Y  T  L  P  A  A  V
1261  TCAACATATCAATTCCAGAGAACTCGGCTATAAACTCTAAATATACTCTCCCAGCGGCTG
 197    D  P  D  V  G  I  N  G  V  Q  N  Y  E  L  I  K  S  Q  N  I
```

Figure 2G-2

```
1321 TTGATCCTGACGTAGGCATAAACGGAGTTCAAAACTACGAACTAATTAAGAGTCAAAACA
 217   F  L  D  V  I  E  T  P  E  G  D  K  M  P  Q  L  I  V  Q
1381 TTTTTGGCCTCGATGTCATTGAAACACCAGAAGGAGACAAGATGCCACAACTGATTGTTC
 237   K  E  L  D  R  E  E  K  D  T  Y  V  M  K  V  K  V  E  D  G
1441 AAAAGGAGTTAGATAGGGAAGAGAAGGATACCTATGTGATGAAAGTAAAGGTTGAAGATG
 257   G  F  P  Q  R  S  S  T  A  I  L  Q  V  S  V  T  D  T  N  D
1501 GTGGCTTTCCTCAAAGATCCAGTACTGCTATTTTGCAAGTAAGTGTTACTGATACAAATG
 277   N  H  P  V  F  K  E  T  E  I  E  V  S  I  P  E  N  A  P  V
1561 ACAACCACCCAGTCTTTAAGGAGACAGAGATTGAAGTCAGTATACCAGAAAATGCTCCTG
 297   G  T  S  V  T  Q  L  H  A  T  D  A  D  I  G  E  N  A  K  I
1621 TAGGCACTTCAGTGACACAGCTCCATGCCACAGATGCTGACATAGGTGAAAATGCCAAGA
 317   H  F  S  F  S  N  L  V  S  N  I  A  R  R  L  F  H  L  N  A
1681 TCCACTTCTCTTTCAGCAATCTAGTCTCCAACATTGCCAGGAGATTATTTCACCTCAATG
 337   T  T  G  L  I  T  I  K  E  P  L  D  R  E  E  T  P  N  H  K
1741 CCACCACTGGACTTATCACAATCAAAGAACCACTGGATAGGGAAGAAACACCAAACCACA
 357   L  L  V  L  A  S  D  G  G  L  M  P  A  R  A  M  V  L  V  N
1801 AGTTACTGGTTTTGGCAAGTGATGGTGGATTGATGCCAGCAAGAGCAATGGTGCTGGTAA
 377   V  T  D  V  N  D  N  V  P  S  I  D  I  R  Y  I  V  N  P  V
1861 ATGTTACAGATGTCAATGATAATGTCCCATCCATTGACATAAGATACATCGTCAATCCTG
 397   N  D  T  V  V  L  S  E  N  I  P  L  N  T  K  I  A  L  I  T
1921 TCAATGACACAGTTGTTCTTTCAGAAAATATTCCACTCAACACCAAAATTGCTCTCATAA
 417   V  T  D  K  D  A  D  H  N  G  R  V  T  C  F  T  D  H  E  I
1981 CTGTGACGGATAAGGATGCGGACCATAATGGCAGGGTGACATGCTTCACAGATCATGAAA
 437   P  F  R  L  R  F  V  F  S  N  Q  F  L  L  E  N  A  A  Y  L
2041 TTCCTTTCAGATTAAGGCCAGTATTCAGTAATCAGTTCCTCCTGGAGAATGCAGCATATC
 457   D  Y  E  S  T  K  E  Y  A  I  K  L  L  A  A  D  A  G  K  P
2101 TTGACTATGAGTCCACAAAAGAATATGCCATTAAATTACTGGCTGCAGATGCTGGCAAAC
 477   P  L  N  Q  S  A  M  L  F  I  K  V  K  D  E  N  D  N  A  P
2161 CTCCTTTGAATCAGTCAGCAATGCTCTTCATCAAAGTGAAAGATGAAAATGACAATGCTC
 497   V  F  T  Q  S  F  V  T  V  S  I  P  E  N  N  S  P  G  I  Q
2221 CAGTTTTCACCCAGTCTTTCGTAACTGTTTCTATTCCTGAGAATAACTCTCCTGGCATCC
 517   L  M  K  V  S  A  T  D  A  D  S  G  P  N  A  E  I  N  Y  L
2281 AGTTGATGAAAGTAAGTGCAACGGATGCAGACAGTGGGCCTAATGCTGAGATCAATTACC
 537   L  G  P  D  A  P  P  E  F  S  L  D  R  R  T  G  M  L  T  V
2341 TGCTAGGCCCTGATGCTCCACCTGAATTCAGCCTGGATCGTCGTACAGGCATGCTGACTG
 557   V  K  K  L  D  R  E  K  E  D  K  Y  L  F  T  I  L  A  K  D
2401 TAGTGAAGAAACTAGATAGAGAAAAAGAGGATAAATATTTATTCACAATTCTGGCAAAAG
 577   N  G  V  P  P  L  T  S  N  V  T  V  F  V  S  I  I  D  Q  N
2461 ATAATGGGGTACCACCCTTAACCAGCAATGTCACAGTCTTTGTAAGCATTATTGATCAGA
 597   D  N  S  P  V  F  T  H  N  E  Y  K  F  Y  V  P  E  N  L  P
2521 ATGACAATAGCCCAGTTTTCACTCACAATGAATACAAATTCTATGTCCCAGAAAACCTTC
```

Figure 2G-3

```
 617      R  H  G  T  V  G  L  I  T  V  T  D  F  D  Y  G  D  N  S  A
2581 CAAGGCATGGTACAGTAGGACTAATCACTGTAACTGATCCTGATTATGGAGACAATTCTG
 637      V  T  L  S  I  L  D  E  N  D  D  F  T  I  D  S  Q  T  G  V
2641 CAGTTACGCTCTCCATTTTAGATGAGAATGATGACTTCACCATTGATTCACAAACTGGTG
 657      I  R  P  N  I  S  F  D  R  E  K  Q  E  S  Y  T  F  Y  V  K
2701 TCATCCGACCAAATATTTCATTTGATAGAGAAAAACAAGAATCTTACACTTTCTATGTAA
 677      A  E  D  G  G  R  V  S  R  S  S  S  A  K  V  T  I  N  V  V
2761 AGGCTGAGGATGGTGGTAGAGTATCACGTTCTTCAAGTGCCAAAGTAACCATAAATGTGG
 697      D  V  N  D  N  K  P  V  F  I  V  P  P  Y  N  Y  S  Y  E  L
2821 TTGATGTCAATGACAACAAACCAGTTTTCATTGTCCCTCCTTACAACTATTCTTATGAAT
 717      V  L  P  S  T  N  P  G  T  V  V  F  Q  V  I  A  V  D  N  D
2881 TGGTTCTACCGTCCACTAATCCAGGCACAGTGGTCTTTCAGGTAATTGCTGTTGACAATG
 737      T  G  M  N  A  E  V  R  Y  S  I  V  G  G  N  T  R  D  L  F
2941 ACACTGGCATGAATGCAGAGGTTCGTTACAGCATTGTAGGAGGAAACACAAGAGATCTGT
 757      A  I  D  Q  E  T  G  N  I  T  L  M  E  K  C  D  V  T  D  L
3001 TTGCAATCGACCAAGAAACAGGCAACATAACATTGATGGAGAAATGTGATGTTACAGACC
 777      G  L  H  R  V  L  V  K  A  N  D  L  G  Q  P  D  S  L  F  S
3061 TTGGTTTACACAGAGTGTTGGTCAAAGCTAATGACTTAGGACAGCCTGATTCTCTCTTCA
 797      V  V  I  V  N  L  F  V  N  E  S  V  T  N  A  T  L  I  N  E
3121 GTGTTGTAATTGTCAATCTGTTCGTGAATGAGTCAGTGACCAATGCTACACTGATTAATG
 817      L  V  R  K  S  I  E  A  P  V  T  P  N  T  E  I  A  D  V  S
3181 AACTGGTGCGCAAAAGCATTGAAGCACCAGTGACCCCAAATACTGAGATAGCTGATGTAT
 837      S  P  T  S  D  Y  V  K  I  L  V  A  A  V  A  G  T  I  T  V
3241 CCTCACCAACTAGTGACTATGTCAAGATCCTGGTTGCAGCTGTTGCTGGCACCATAACTG
 857      V  V  V  I  F  I  T  A  V  V  R  C  R  Q  A  P  H  L  K  A
3301 TCGTTGTAGTTATTTTCATCACTGCTGTAGTAAGATGTCGCCAGGCACCACACCTTAAGG
 877      A  Q  K  N  M  Q  N  S  E  W  A  T  P  N  P  E  N  R  Q  M
3361 CTGCTCAGAAAAACATGCAGAATTCTGAATGGGCTACCCCAAACCCAGAAAACAGGCAGA
 897      I  M  M  K  K  K  K  K  K  K  K  H  S  P  K  N  L  L  L  N
3421 TGATAATGATGAAGAAAAAGAAAAAGAAGAAGAAGCATTCCCCTAAGAACCTGCTGCTTA
 917      V  V  T  I  E  E  T  K  A  D  D  V  D  S  D  G  N  R  V  T
3481 ATGTTGTCACTATTGAAGAAACTAAGGCAGATGATGTTGACAGTGATGGAAACAGAGTCA
 937      L  D  L  P  I  D  L  E  E  Q  T  M  G  K  Y  N  W  V  T  T
3541 CACTAGACCTTCCTATTGATCTAGAAGAGCAAACAATGGGAAAGTACAATTGGGTAACTA
 957      P  T  T  F  K  P  D  S  P  D  L  A  R  H  Y  K  S  A  S  P
3601 CACCTACTACTTTCAAGCCTGACAGCCCTGATTTGGCCCGACACTACAAATCTGCCTCTC
 977      Q  P  A  F  Q  I  Q  P  E  T  P  L  N  L  K  H  H  I  I  Q
3661 CACAGCCTGCCTTCCAAATTCAGCCTGAAACTCCCCTGAATTTGAAGCACCACATCATCC
 997      E  L  P  L  D  N  T  F  V  A  C  D  S  I  S  N  C  S  S
3721 AAGAACTGCCTCTCGATAACACCTTTGTGGCCTGTGACTCTATCTCCAATTGTTCCTCAA
1017     S  S  D  P  Y  S  V  S  D  C  G  Y  P  V  T  T  F  E  V  P
```

Figure 2G-4

```
3781  GCAGTTCAGATCCCTACAGCGTTTCTGACTGTGGCTATCCAGTGACAACCTTCGAGGTAC
1037   V  S  V  H  T  R  P  T  D  S  R  T  *
3841  CTGTGTCCGTACACACCAGACCGACTGATTCCAGGACATGAactattgaaatctgcagtg
3901  agatgtaactttctaggaacaacaaaattccattcccttccaaaaaatttcaatgattg
3961  tgatttcaaaattaggctaagatcattaattttgtaatctagatttcccattataaaagc
4021  aagcaaaaatcatcttaaaaatgatgtcctagtgaaccttgtgctttctttagctgtaat
4081  ctggcaatggaaatttaaaatttatggaagagacagtgcagcgcaataacagagtactct
4141  catgctgtttctctgtttgctctgaatcaacagccatgatgtaatataaggctgtcttgg
4201  tgtatacacttatggttaatatatcagtcatgaaacatgcaattacttgccctgtctgat
4261  tgttgaataattaaaacattatctccaggagtttggaagtgagctgaactagccaaacta
4321  ctctctgaaaggtatccagggcaagagacattttttaagaccccaaacaaacaaaaacaa
4381  aaccaaaacactctggttcagtgttttgaaaatattgactaacataatattgctgagaaa
4441  atcattttattacccaccactctgcttaaaagttgagtgggccgggcgcggtggctcac
4501  gcctgtaattccagcactttgggaggccgaggcgggtggatcacgaggtcaggatattga
4561  gaccatcctggctaacatggtgaaaccccatctccactaaaaatacaaaaaattagctgg
4621  gcgtggtggcgggcgcctgtagtcccagctactcgggaggctgaggcaggagaatggcgt
4681  gaacccgggaggcggagcttgcagtgagccgagatggcgccactgcactccagcctgggt
4741  gacagagcaagactctgtctcaaaaagaaaaaaatgttcagtgatagaaaataatttac
4801  taggtttttatgttgattgtactcatgctgttccactccttttaattattaaaaagttat
4861  ttttggctgggtgtggtggctcatacctgtaatcccagcactttgggaggccgaggcggg
4921  tggatcacctgaggtcaggagttcaagaccagtctggccaacat
```

Figure 2H. The cDNA (SEQ ID NO:16) and amino acid sequence (SEQ ID NO:17) of 109P1D4 v.8. The start methionine is underlined. The open reading frame extends from nucleic acid 735-4757 including the stop codon.

```
  1    ggtggtccagtacctccaaagatatggaatacactcctgaaatatcctgaaacctttttt
 61    ttttcagaatcctttaataagcagttatgtcaatctgaaagttgcttacttgtactttat
121    attaatagctattcttgttttcttatccaaagaaaaatcctctaatccccttttcacat
181    gatagttgttaccatgtttaggcgttagtcacatcaacccctctcctctcccaaacttct
241    cttcttcaaatcaaactttattagtccctccttttataatgattccttgcctccttttatc
301    cagatcaattttttttcactttgatgcccagagctgaagaaatggactattgtataaatt
361    attcattgccaagagaataattgcattttaaacccatgttataacaaagaataatgatta
421    tattttgtgatttgtaacaaatacccttttattttcccttaactattgaattaaatattt
481    aattatttgtattctctttaactatcttggtatattaaagtattatcttttatatattta
541    tcaatggtggacacttttataggtactctgtgtcattttttgatactgtaggtatcttatt
601    tcatttatctttattcttaatgtacgaattcataatatttgattcagaacagatttatca
661    ctaattaacagagtgtcaattatgctaacatctcatttactgattttaatttaaaacagt
  1                        M  F  R  V  G  F  L  I  I  S  S  S  S  L  S
721    ttttgttaacatgcATGTTTAGGGTTGGCTTCTTAATAATTTCTTCTTCCTCTTCTCTCT
 17     P  L  L  V  S  V  V  R  V  N  T  N  C  H  K  C  L  L
781    CTCCTCTTCTTTTGGTCAGTGTTGTGCGGGTTAATACAACAAACTGTCACAAGTGTTTGT
 37     S  G  T  Y  I  F  A  V  L  L  V  C  V  V  F  H  S  G  A  Q
```

Figure 2H-2

```
 841 TGTCCGGGACGTACATTTTCGCGGTCCTGCTAGTATGCGTGGTGTTCCACTCTGGCGCCC
  57   E  K  N  Y  T  I  R  E  E  I  P  E  N  V  L  I  G  N  L  L
 901 AGGAGAAAAACTACACCATCCGAGAAGAAATTCCAGAAAACGTCCTGATAGGCAACTTGT
  77   K  D  L  N  L  S  L  I  P  N  K  S  L  T  T  I  M  Q  F  K
 961 TGAAAGACCTTAACTTGTCGCTGATTCCAAACAAGTCCTTGACAACTACTATGCAGTTCA
  97   L  V  Y  K  T  G  D  V  P  L  I  R  I  E  E  D  T  G  E  I
1021 AGCTAGTGTACAAGACCGGAGATGTGCCACTGATTCGAATTGAAGAGGATACTGGTGAGA
 117   F  T  T  G  A  R  I  D  R  E  K  L  C  A  G  I  P  R  D  E
1081 TCTTCACTACCGGCGCTCGCATTGATCGTGAGAAATTATGTGCTGGTATCCCAAGGGATG
 137   H  C  F  Y  E  V  E  V  A  I  L  P  D  E  I  F  R  L  V  K
1141 AGCATTGCTTTTATGAAGTGGAGGTTGCCATTTTGCCGGATGAAATATTTAGACTGGTTA
 157   I  R  F  L  I  E  D  I  N  D  N  A  P  L  F  P  A  T  V  I
1201 AGATACGTTTTCTGATAGAAGATATAAATGATAATGCACCATTGTTCCCAGCAACAGTTA
 177   N  I  S  I  P  E  N  S  A  I  N  S  K  Y  T  L  P  A  A  V
1261 TCAACATATCAATTCCAGAGAACTCGGCTATAAACTCTAAATATACTCTCCCAGCGGCTG
 197   D  P  D  V  G  I  N  G  V  Q  N  Y  E  L  I  K  S  Q  N  I
1321 TTGATCCTGACGTAGGCATAAACGGAGTTCAAAACTACGAACTAATTAAGAGTCAAAACA
 217   F  G  L  D  V  I  E  T  P  E  G  D  K  M  P  Q  L  I  V  Q
1381 TTTTTGGCCTCGATGTCATTGAAACACCAGAAGGAGACAAGATGCCACAACTGATTGTTC
 237   K  E  L  D  R  E  E  K  D  T  Y  V  M  K  V  K  V  E  D  G
1441 AAAAGGAGTTAGATAGGGAAGAGAAGGATACCTATGTGATGAAAGTAAAGGTTGAAGATG
 257   G  F  P  Q  R  S  S  T  A  I  L  Q  V  S  V  T  D  T  N  D
1501 GTGGCTTTCCTCAAAGATCCAGTACTGCTATTTTGCAAGTAAGTGTTACTGATACAAATG
 277   N  H  P  V  F  K  E  T  E  I  E  V  S  I  P  E  N  A  P  V
1561 ACAACCACCCAGTCTTTAAGGAGACAGAGATTGAAGTCAGTATACCAGAAAATGCTCCTG
 297   G  T  S  V  T  Q  L  H  A  T  D  A  D  I  G  E  N  A  K  I
1621 TAGGCACTTCAGTGACACAGCTCCATGCCACAGATGCTGACATAGGTGAAAATGCCAAGA
 317   H  F  S  F  S  N  L  V  S  N  I  A  R  R  L  F  H  L  N  A
1681 TCCACTTCTCTTTCAGCAATCTAGTCTCCAACATTGCCAGGAGATTATTTCACCTCAATG
 337   T  T  G  L  I  T  I  K  E  P  L  D  R  E  E  T  P  N  H  K
1741 CCACCACTGGACTTATCACAATCAAAGAACCACTGGATAGGGAAGAAACACCAAACCACA
 357   L  L  V  L  A  S  D  G  G  L  M  P  A  R  A  M  V  L  V  N
1801 AGTTACTGGTTTTGGCAAGTGATGGTGGATTGATGCCAGCAAGAGCAATGGTGCTGGTAA
 377   V  T  D  V  N  D  N  V  P  S  I  D  I  R  Y  I  V  N  P  V
1861 ATGTTACAGATGTCAATGATAATGTCCCATCCATTGACATAAGATACATCGTCAATCCTG
 397   N  D  T  V  V  L  S  E  N  I  P  L  N  T  K  I  A  L  I  T
1921 TCAATGACACAGTTGTTCTTTCAGAAAATATTCCACTCAACACCAAAATTGCTCTCATAA
 417   V  T  D  K  D  A  D  H  N  G  R  V  T  C  F  T  D  H  E  I
1981 CTGTGACGGATAAGGATGCGGACCATAATGGCAGGGTGACATGCTTCACAGATCATGAAA
 437   P  F  R  L  R  P  V  F  S  N  Q  F  L  L  E  N  A  A  Y  L
2041 TTCCTTTCAGATTAAGGCCAGTATTCAGTAATCAGTTCCTCCTGGAGAATGCAGCATATC
```

Figure 2H-3

```
457    D  Y  E  S  T  K  E  Y  A  I  K  L  L  A  A  D  A  G  K  P
2101 TTGACTATGAGTCCACAAAAGAATATGCCATTAAATTACTGGCTGCAGATGCTGGCAAAC
477    F  L  N  Q  S  A  M  L  F  I  K  V  K  D  E  N  D  N  A  P
2161 CTCCTTTGAATCAGTCAGCAATGCTCTTCATCAAAGTGAAAGATGAAAATGACAATGCTC
497    V  F  T  Q  S  F  V  T  V  S  I  P  E  N  N  S  P  G  I  Q
2221 CAGTTTTCACCCAGTCTTTCGTAACTGTTTCTATTCCTGAGAATAACTCTCCTGGCATCC
517    L  M  K  V  S  A  T  D  A  D  S  G  P  N  A  E  I  N  Y  L
2281 AGTTGATGAAAGTAAGTGCAACGGATGCAGACAGTGGGCCTAATGCTGAGATCAATTACC
537    L  G  P  D  A  P  P  E  F  S  L  D  R  R  T  G  M  L  T  V
2341 TGCTAGGCCCTGATGCTCCACCTGAATTCAGCCTGGATCGTCGTACAGGCATGCTGACTG
557    V  K  K  L  D  R  E  K  E  D  K  Y  L  F  T  I  L  A  K  D
2401 TAGTGAAGAAACTAGATAGAGAAAAAGAGGATAAATATTTATTCACAATTCTGGCAAAAG
577    N  G  V  P  P  L  T  S  N  V  T  V  F  V  S  I  I  D  Q  N
2461 ATAATGGGGTACCACCCTTAACCAGCAATGTCACAGTCTTTGTAAGCATTATTGATCAGA
597    D  N  S  P  V  F  T  H  N  E  Y  K  F  Y  V  P  E  N  L  P
2521 ATGACAATAGCCCAGTTTTCACTCACAATGAATACAAATTCTATGTCCCAGAAAACCTTC
617    R  H  G  T  V  G  L  I  T  V  T  D  P  D  Y  G  D  N  S  A
2581 CAAGGCATGGTACAGTAGGACTAATCACTGTAACTGATCCTGATTATGGAGACAATTCTG
637    V  T  L  S  I  L  D  E  N  D  D  F  T  I  D  S  Q  T  G  V
2641 CAGTTACGCTCTCCATTTTAGATGAGAATGATGACTTCACCATTGATTCACAAACTGGTG
657    I  R  P  N  I  S  F  D  R  E  K  Q  E  S  Y  T  F  Y  V  K
2701 TCATCCGACCAAATATTTCATTTGATAGAGAAAAACAAGAATCTTACACTTTCTATGTAA
677    A  E  D  G  G  R  V  S  R  S  S  S  A  K  V  T  I  N  V  V
2761 AGGCTGAGGATGGTGGTAGAGTATCACGTTCTTCAAGTGCCAAAGTAACCATAAATGTGG
697    D  V  N  D  N  K  P  V  F  I  V  P  P  Y  N  Y  S  Y  E  L
2821 TTGATGTCAATGACAACAAACCAGTTTTCATTGTCCCTCCTTACAACTATTCTTATGAAT
717    V  L  P  S  T  N  P  G  T  V  V  F  Q  V  I  A  V  D  N  D
2881 TGGTTCTACCGTCCACTAATCCAGGCACAGTGGTCTTTCAGGTAATTGCTGTTGACAATG
737    T  G  M  N  A  E  V  R  Y  S  I  V  G  G  N  T  R  D  L  F
2941 ACACTGGCATGAATGCAGAGGTTCGTTACAGCATTGTAGGAGGAAACACAAGAGATCTGT
757    A  I  D  Q  E  T  G  N  I  T  L  M  E  K  C  D  V  T  D  L
3001 TTGCAATCGACCAAGAAACAGGCAACATAACATTGATGGAGAAATGTGATGTTACAGACC
777    G  L  H  R  V  L  V  K  A  N  D  L  G  Q  P  D  S  L  F  S
3061 TTGGTTTACACAGAGTGTTGGTCAAAGCTAATGACTTAGGACAGCCTGATTCTCTCTTCA
797    V  V  I  V  N  L  F  V  N  E  S  V  T  N  A  T  L  I  N  E
3121 GTGTTGTAATTGTCAATCTGTTCGTGAATGAGTCAGTGACCAATGCTACACTGATTAATG
817    L  V  R  K  S  I  E  A  P  V  T  P  N  T  E  I  A  D  V  S
3181 AACTGGTGCGCAAAAGCATTGAAGCACCAGTGACCCCAAATACTGAGATAGCTGATGTAT
837    S  P  T  S  D  Y  V  K  I  L  V  A  A  V  A  G  T  I  T  V
3241 CCTCACCAACTAGTGACTATGTCAAGATCCTGGTTGCAGCTGTTGCTGGCACCATAACTG
857    V  V  V  I  F  I  T  A  V  V  R  C  R  Q  A  P  H  L  K  A
```

Figure 2H-4

```
3301 TCGTTGTAGTTATTTTCATCACTGCTGTAGTAAGATGTCGCCAGGCACCACACCTTAAGG
 877   A  Q  K  N  M  Q  N  S  E  W  A  T  P  N  P  E  N  R  Q  M
3361 CTGCTCAGAAAAACATGCAGAATTCTGAATGGGCTACCCCAAACCCAGAAAACAGGCAGA
 897   I  M  M  K  K  K  K  K  K  K  H  S  P  K  N  L  L  L  N
3421 TGATAATGATGAAGAAAAGAAAAAGAAGAAGAAGCATTCCCCTAAGAACCTGCTGCTTA
 917   V  V  T  I  E  E  T  K  A  D  D  V  D  S  D  G  N  R  V  T
3481 ATGTTGTCACTATTGAAGAAACTAAGGCAGATGATGTTGACAGTGATGGAAACAGAGTCA
 937   L  D  L  P  I  D  L  E  E  Q  T  M  G  K  Y  N  W  V  T  T
3541 CACTAGACCTTCCTATTGATCTAGAAGAGCAAACAATGGGAAAGTACAATTGGGTAACTA
 957   P  T  T  F  K  P  D  S  P  D  L  A  R  H  Y  K  S  A  S  P
3601 CACCTACTACTTTCAAGCCTGACAGCCCTGATTTGGCCCGACACTACAAATCTGCCTCTC
 977   Q  P  A  F  Q  I  Q  P  E  T  P  L  N  K  H  H  I  I  Q
3661 CACAGCCTGCCTTCCAAATTCAGCCTGAAACTCCCCTGAATTTGAAGCACCACATCATCC
 997   E  L  P  L  D  N  T  F  V  A  C  D  S  I  S  N  C  S  S  S
3721 AAGAACTGCCTCTCGATAACACCTTTGTGGCCTGTGACTCTATCTCCAATTGTTCCTCAA
1017   S  S  D  P  Y  S  V  S  D  C  G  Y  P  V  T  F  E  V  P
3781 GCAGTTCAGATCCCTACAGCGTTTCTGACTGTGGCTATCCAGTGACAACCTTCGAGGTAC
1037   V  S  V  H  T  R  P  S  Q  R  R  V  T  F  H  L  P  E  G  S
3841 CTGTGTCCGTACACACCAGACCGTCCCAGCGGCGTGTCACATTTCACCTGCCAGAAGGCT
1057   Q  E  S  S  S  D  G  G  L  G  D  H  D  A  G  S  L  T  S  T
3901 CTCAGGAAAGCAGCAGTGATGGTGGACTGGGAGACCATGATGCAGGCAGCCTTACCAGCA
1077   S  H  G  L  P  L  G  Y  P  Q  E  E  Y  F  D  R  A  T  P  S
3961 CATCCCATGGCCTGCCCCTTGGCTATCCTCAGGAGGAGTACTTTGATCGTGCTACACCCA
1097   N  R  T  E  G  D  G  N  S  D  P  E  S  T  F  I  P  G  L  K
4021 GCAATCGCACTGAAGGGGATGGCAACTCCGATCCTGAATCTACTTTCATACCTGGACTAA
1117   K  E  I  T  V  Q  P  T  V  E  E  A  S  D  N  C  T  Q  E  C
4081 AGAAAGAAATAACTGTTCAACCAACTGTGGAAGAGGCCTCTGACAACTGCACTCAAGAAT
1137   L  I  Y  G  H  S  D  A  C  W  M  P  A  S  L  D  H  S  S  S
4141 GTCTCATCTATGGCCATTCTGATGCCTGCTGGATGCCGGCATCTCTGGATCATTCCAGCT
1157   S  Q  A  Q  A  S  A  L  C  H  S  P  P  L  S  Q  A  S  T  Q
4201 CTTCACAAGCACAGGCCTCTGCTCTATGCCACAGCCCACCACTGTCACAGGCCTCTACTC
1177   H  H  S  P  P  V  T  Q  T  I  V  L  C  H  S  P  P  V  T  Q
4261 AGCACCACAGCCCACCAGTGACACAGACCATTGTTCTGCCACAGCCCTCCAGTGACAC
1197   T  I  A  L  C  H  S  P  P  I  Q  V  S  A  L  H  H  S  P
4321 AGACCATCGCATTGTGCCACAGCCCACCACCGATACAGGTGTCTGCTCTCCACCACAGTC
1217   P  L  V  Q  G  T  A  L  H  H  S  P  P  S  A  Q  A  S  A  L
4381 CTCCTCTAGTGCAGGGTACTGCACTTCACCACAGCCCACCATCAGCACAGGCCTCAGCCC
1237   C  Y  S  P  P  L  A  Q  A  A  A  I  S  H  S  S  S  L  P  Q
4441 TCTGCTACAGCCCTCCTTTAGCACAGGCTGCTGCAATCAGCCACAGCTCTTCTCTGCCAC
1257   V  I  A  L  H  R  S  Q  A  Q  S  S  V  S  L  Q  Q  G  W  V
4501 AGGTTATTGCCCTCCATCGTAGTCAGGCCCAATCATCAGTCAGTTTGCAGCAAGGTTGGG
```

Figure 2H-5

```
1277   Q  G  A  N  G  L  C  S  V  D  Q  G  V  Q  G  S  A  T  S  Q
4561 TGCAAGGTGCTAATGGACTATGCTCTGTTGATCAGGGAGTGCAAGGTAGTGCAACATCTC
1297   F  Y  T  M  S  E  R  L  H  P  S  D  D  S  I  K  V  I  P  L
4621 AGTTTTACACCATGTCTGAAAGACTTCATCCCAGTGATGATTCAATTAAAGTCATTCCTT
1317   T  T  F  A  P  R  Q  Q  A  R  P  S  R  G  D  S  P  I  M  E
4681 TGACAACCTTCGCTCCACGCCAACAGGCCAGACCGTCCAGAGGTGATTCCCCCATTATGG
1337   T  H  P  L  *
4741 AAACACATCCCTTGTAAgctaaaatagttacttcaaattttcagaaaagatgtatatag
4801 tcaaaatttaagatacaattccaatgagtattctgattatcagatttgtaaataactatg
4861 taaatagaaacagataccagaataaatctacagctagacccttagtcaatagttaaccaa
4921 aaaattgcaatttgtttaattcagaatgtgtatttaaaaagaaaaggaatttaacaattt
4981 gcatcccccttgtacagtaaggcttatcatgacagagcgtactatttctgatgtacagtat
5041 tttttgttgtttttatcatcatgtgcaatattactgatttgtttccatgctgattgtgtg
5101 gaaccagtatgtagcaaatggaaagcctagaaatatcttattttctaagtttacctttag
5161 tttacctaaacttttgttcagataatgttaaaaggtatacgtactctagccttttttggg
5221 gctttcttttgattttttgtttgtggttttcagttttttttgttgttgttagtgagtctcc
5281 cttcaaaatacacagtaggtagtgtaaatactgcttgtttgtgtctctctgctgtcatgt
5341 tttctaccttattccaatactatattgttgataaaatttgtatatacattttcaataaag
5401 aatatgtataaactgtacagatctagatctacaacctatttctctactctttagtagagt
5461 tcgagacacagaagtgcaataactgccctaattaagcaactatttgttaaaaagggcccc
5521 ttttttacttaatagtttagtgtaaagtacatcagaaataaaactgtatctgacatttta
5581 agcctgtagtccattattacttgggtctttacttctgggaatttgtatgtaacagcctag
5641 aaaattaaaaggaggtggatgcatccaaagcacgagtcacttaaaatatcgacggtaaac
5701 tactattttgtagagaaactcaggaagatttaaatgttgatttgacagctcaataggctg
5761 ttaccaaagggtgttcagtaaaaataacaaatacatgtaactgtagataaaaccacatac
5821 taaatctataagactaagggattttttgttattctagctcaacttactgaagaaaaccact
5881 aataacaacaagaatatcaggaaggaacttttcaagaaatgtaattataaatctacatca
5941 aacagaattttaaggaaaaatgcagagggagaaataaggcacatgactgcttcttgcagt
6001 caagaagaaataccaataacacacacagaacaaaaaccatcaaaatctcatatatgaaat
6061 aaaatatattcttctaagcaaagaaacagtactattcatagaaaacattagtttttctcct
6121 gttgtctgttatttccttctttttatcctcttaactggccattatcttgtatgtgcacatt
6181 ttataaatgtacagaaacatcaccaacttgattttcttccatagcaaaactgagaaaata
6241 ccttgtttcagtataacactaaaccaagagacaattgatgtttaatgggggcggttgggg
6301 ttgggggggagtcaatatctcctattgattaacttagacatagattttgtaatgtataac
6361 ttgatatttaatttatgattaaactgtaattttgtaacataaactgtggtaattgcataa
6421 tttcattggtgaggatttcctttgaatattgagaaagtttcttttcatgtgcccagcagg
6481 ttaagtagcgttttcagaatatacattattcccatccattgtaaagttccttaagtcata
6541 tttgactgggcgtgcagaataacttcttaactattaactatcagagtttgattaataaaa
6601 ttaattaattttttttctccttcgtgttgttaatgttccaagggatttggagcatactgg
6661 ttttccaggtgcatgtgaatcccgaaggactgatgatatttgaatgtttattaaattatt
6721 atcacacaaatgtgttgatattgtggctattgttgatgttgaaaattgtaaacttgggga
```

Figure 2H-6

```
6781 agattaagaaaagaaccaatagtgacaaaaatcagtgcttccagtagattttagaacatt
6841 ctttgcctcaaaaaacctgcaaagatgatgtgagattttttcttgtgttttaattatttt
6901 cacattttctctctgcaaacctttagttttctgatgatctacacacacacatacacacac
6961 acacacacacgtgcacacacacatttaaaggatataaaaagaagaggttgaaagat
7021 tattaaataacttatcaggcatctcaatggttactatctatgttagtgaaaatcaaatag
7081 gactcaaagttggatatttgggattttttcttctgacagtataatttattgagttactagg
7141 gaggttcttaaatcctcatatctggaaacttgtgaagttttgacacctttcctatagata
7201 taggaatgaaccaatacgcttttattaccctttctaactctgattttataatcagactta
7261 gattgtgtttagaatattaaatgactgggcaccctcttcttggttttaccagagaggct
7321 ttgaatggaagcaggctgagagtagccaaagaggcaaggggtattagcccagttattctc
7381 ccctatgccttctcttcctaagcgtccactaggtctggccttggaaatctgttacttcta
7441 cggcttcagatctgatgatatctttttcatcacattacaagttatttctttgactaata
7501 gacagtggtataggttgacacagcacacaagtggctattgtgatgtatgatgtatgtagt
7561 cccacaactgcaaaacgtcttactgaagcaacaatcgaaaaatggttctgttttaaaaag
7621 gatttgtttgatttgaaattaaaacttcaaactgaatgacttatatgagaataatatgt
7681 tcaatcaaagtagttattctattttgtgtccatattccattagattgtgattattaattt
7741 tctagctatggtattactatatcacacttgtgagtatgtattcaaatactaagtatctta
7801 tatgctacgtgcatacacattcttttcttaaactttacctgtgttttaactaatattgtg
7861 tcagtgtattaaaaattagcttttacatatgatatctacaatgtaataaatttagagagt
7921 aattttgtgtattcttatttacttaacattttactttaattatgtaaatttggttagaa
7981 aataataataaatggttagtgctattgtgtaatggtagcagttacaaagagcctctgcct
8041 tcccaaactaatatttatcacacatggtcattaaatgggaaaaaaatagactaaacaaat
8101 cacaaattgttcagttcttaaaatgtaattatgtcacacacacaaaaaaatccttttcaa
8161 tcctgagaaaattaaaggtgttttactcacatggatatttcaacattagttttttttgtt
8221 tgtttcttttttcatggtattactgaaggtgtgtatactccctaatacacatttatgaaaa
8281 tctacttgtttagacttttatttatactcttctgatttatattttttattataattatta
8341 tttcttatcttcttttatattttttggaaaccaaatttatagttagtttaggtaaacttt
8401 ttattatgaccattagaaactattttgaatgtttccaactggctcaattggctgggaaaa
8461 catgggaacaagagaagctgaaatatttctgcaagaaccttctatattatgtgccaa
8521 ttaccacaccagatcaattttatgcagaggccttaaaatattcttcacagtagctttct
8581 tacactaaccgtcatgtgctttagtaaatatgattttaaaagcagttcaagttgacaa
8641 cagcagaaacagtaacaaaaaaatctgctcagaaaatgtatgtgcacaaataaaaaaaa
8701 ttaatggcaattgtttagtgactgtaagtgatacttttaaagagtaaactgtgtgaaat
8761 ttatactatccctgcttaaaatattaagattttatgaaatatgtatttatgtttgtatt
8821 gtgggaagattcctcctctgtgatatcatacagcatctgaaagtgaacagtatcccaaag
8881 cagttccaagcatgctttggaagtaagaaggttgactattgtatggccaaggatggcagt
8941 atgtaatccagaagcaaacttgtattaattgttctatttcaggttctgtattgcatgttt
9001 tcttattaatatatattaataaaagttatgagaaat
```

Figure 2I. The cDNA (SEQ ID NO:18) and amino acid sequence (SEQ ID NO:19) of 109P1D4 v.9. The start methionine is underlined. The open reading frame extends from nucleic acid 514-3627 including the stop codon.

```
   1 cccctttctcccctctgttaagtccctcccctcgccattcaaaagggctggctcggca
  61 ctggctccttgcagtcggcgaactgtctgggcgggaggagccgtgagcagtagctgcact
 121 cagctgcccgcgcggcaaagaggaaggcaagccaaacagagtgcgcagagtggcagtgcc
 181 agcggcgacacaggcagcacaggcagcccgggctgcctgaatagcctcagaaacaacctc
 241 agcgactccggctgctctgcggactgcgagctgtggcggtagagcccgctacagcagtcg
 301 cagtctccgtggagcgggcggaagccttttttctccctttcgtttacctcttcattctac
 361 tctaaaggcatcgttattaggaaaatcctgttgtgaataagaaggattccacagatcaca
 421 taccagagcggttttgcctcagctgctctcaactttgtaatcttgtgaagaagctgacaa
```

```
   1                                              M  T  V  G  F  N  S  D  I
 481 gcttggctgattgcagtgcactatgaggactgaATGACAGTGGGTTTTAATTCAGATATT
  10 S  S  V  V  R  V  N  T  T  N  C  H  K  C  L  L  S  G  T  Y
 541 TCAAGTGTTGTGCGGGTTAATACAACAAACTGTCACAAGTGTTTGTTGTCCGGGACGTAC
  30 I  F  A  V  L  L  V  C  V  V  F  H  S  G  A  Q  E  K  N  Y
 601 ATTTTCGCGGTCCTGCTAGTATGCGTGGTGTTCCACTCTGGCGCCCAGGAGAAAAACTAC
  50 T  I  R  E  E  I  P  E  N  V  L  I  G  N  L  L  K  D  L  N
 661 ACCATCCGAGAAGAAATTCCAGAAAACGTCCTGATAGGCAACTTGTTGAAAGACCTTAAC
  70 L  S  L  I  P  N  K  S  L  T  T  M  Q  F  K  L  V  Y  K
 721 TTGTCGCTGATTCCAAACAAGTCCTTGACAACTATGCAGTTCAAGCTAGTGTACAAG
  90 T  G  D  V  P  L  I  R  I  E  D  T  G  E  I  F  T  T  G
 781 ACCGGAGATGTGCCACTGATTCGAATTGAAGAGGATACTGGTGAGATCTTCACTACCGGC
 110 A  R  I  D  R  E  K  L  C  A  G  I  P  R  D  E  H  C  F  Y
 841 GCTCGCATTGATCGTGAGAAATTATGTGCTGGTATCCCAAGGGATGAGCATTGCTTTTAT
 130 E  V  E  V  A  I  L  P  D  E  I  F  R  L  V  K  I  R  F  L
 901 GAAGTGGAGGTTGCCATTTTGCCGGATGAAATATTTAGACTGGTTAAGATACGTTTTCTG
 150 I  E  D  I  N  D  N  A  P  L  F  P  A  T  V  I  N  I  S  I
 961 ATAGAAGATATAAATGATAATGCACCATTGTTCCCAGCAACAGTTATCAACATATCAATT
 170 P  E  N  S  A  I  N  S  K  Y  T  L  P  A  A  V  D  P  D  V
1021 CCAGAGAACTCGGCTATAAACTCTAAATATACTCTCCCAGCGGCTGTTGATCCTGACGTA
 190 G  I  N  G  V  Q  N  Y  E  L  I  K  S  Q  N  I  F  G  L  D
1081 GGCATAAACGGAGTTCAAAACTACGAACTAATTAAGAGTCAAAACATTTTGGCCTCGAT
 210 V  I  E  T  F  E  G  D  K  M  P  Q  L  I  V  Q  K  E  L  D
1141 GTCATTGAAACACCAGAAGGAGACAAGATGCCACAACTGATTGTTCAAAAGGAGTTAGAT
 230 R  E  E  K  D  T  Y  V  M  K  V  K  V  E  D  G  G  F  P  Q
1201 AGGGAAGAGAAGGATACCTATGTGATGAAAGTAAAGGTTGAAGATGGTGGCTTTCCTCAA
 250 R  S  S  T  A  I  L  Q  V  S  V  T  D  T  N  D  N  H  P  V
1261 AGATCCAGTACTGCTATTTTGCAAGTAAGTGTTACTGATACAAATGACAACCACCCAGTC
 270 F  K  E  T  E  I  E  V  S  I  P  E  N  A  P  V  G  T  S  V
1321 TTTAAGGAGACAGAGATTGAAGTCAGTATACCAGAAAATGCTCCTGTAGGCACTTCAGTG
 290 T  Q  L  H  A  T  D  A  D  I  G  E  N  A  K  I  H  F  S  F
1381 ACACAGCTCCATGCCACAGATGCTGACATAGGTGAAAATGCCAAGATCCACTTCTCTTTC
```

Figure 2I-2

```
 310 S  N  L  V  S  N  I  A  R  R  L  F  H  L  N  A  T  T  G  L
1441 AGCAATCTAGTCTCCAACATTGCCAGGAGATTATTTCACCTCAATGCCACCACTGGACTT
 330 I  T  I  K  E  P  L  D  R  E  E  T  P  N  H  K  L  L  V  L
1501 ATCACAATCAAAGAACCACTGGATAGGGAAGAAACACCAAACCACAAGTTACTGGTTTTG
 350 A  S  D  G  G  L  M  P  A  R  A  M  V  L  V  N  V  T  D  V
1561 GCAAGTGATGGTGGATTGATGCCAGCAAGAGCAATGGTGCTGGTAAATGTTACAGATGTC
 370 N  D  N  V  P  S  I  D  I  R  Y  I  V  N  P  V  N  D  T  V
1621 AATGATAATGTCCCATCCATTGACATAAGATACATCGTCAATCCTGTCAATGACACAGTT
 390 V  L  S  E  N  I  P  L  N  T  K  I  A  L  I  T  V  T  D  K
1681 GTTCTTTCAGAAAATATTCCACTCAACACCAAAATTGCTCTCATAACTGTGACGGATAAG
 410 D  A  D  H  N  G  R  V  T  C  F  T  D  H  E  I  P  F  R  L
1741 GATGCGGACCATAATGGCAGGGTGACATGCTTCACAGATCATGAAATTCCTTTCAGATTA
 430 R  P  V  F  S  N  Q  F  L  L  E  N  A  A  Y  L  D  Y  E  S
1801 AGGCCAGTATTCAGTAATCAGTTCCTCCTGGAGAATGCAGCATATCTTGACTATGAGTCC
 450 I  K  E  Y  A  I  K  L  L  A  A  D  A  G  K  P  P  L  N  Q
1861 ACAAAAGAATATGCCATTAAATTACTGGCTGCAGATGCTGGCAAACCTCCTTTGAATCAG
 470 S  A  M  L  F  I  K  V  K  D  E  N  D  N  A  P  V  F  T  Q
1921 TCAGCAATGCTCTTCATCAAAGTGAAAGATGAAAATGACAATGCTCCAGTTTTCACCCAG
 490 S  F  V  T  V  S  I  P  E  N  N  S  P  G  I  Q  L  M  K  V
1981 TCTTTCGTAACTGTTTCTATTCCTGAGAATAACTCTCCTGGCATCCAGTTGATGAAAGTA
 510 S  A  T  D  A  D  S  G  P  N  A  E  I  N  Y  L  L  G  P  D
2041 AGTGCAACGGATGCAGACAGTGGGCCTAATGCTGAGATCAATTACCTGCTAGGCCCTGAT
 530 A  P  P  E  F  S  L  D  R  R  T  G  M  L  T  V  V  K  K  L
2101 GCTCCACCTGAATTCAGCCTGGATCGTCGTACAGGCATGCTGACTGTAGTGAAGAAACTA
 550 D  R  E  K  E  D  K  Y  L  F  T  I  L  A  K  D  N  G  V  P
2161 GATAGAGAAAAAGAGGATAAATATTTATTCACAATTCTGGCAAAAGATAATGGGGTACCA
 570 P  L  T  S  N  V  T  V  F  V  S  I  I  D  Q  N  D  N  S  P
2221 CCCTTAACCAGCAATGTCACAGTCTTTGTAAGCATTATTGATCAGAATGACAATAGCCCA
 590 V  F  T  H  N  E  Y  K  F  Y  V  P  E  N  L  P  R  H  G  T
2281 GTTTTCACTCACAATGAATACAAATTCTATGTCCCAGAAAACCTTCCAAGGCATGGTACA
 610 V  G  L  I  T  V  T  D  P  D  Y  G  D  N  S  A  V  T  L  S
2341 GTAGGACTAATCACTGTAACTGATCCTGATTATGGAGACAATTCTGCAGTTACGCTCTCC
 630 I  L  D  E  N  D  D  F  T  I  D  S  Q  T  G  V  I  R  P  N
2401 ATTTTAGATGAGAATGATGACTTCACCATTGATTCACAAACTGGTGTCATCCGACCAAAT
 650 I  S  F  D  R  E  K  Q  E  S  Y  T  F  Y  V  K  A  E  D  G
2461 ATTTCATTTGATAGAGAAAAACAAGAATCTTACACTTTCTATGTAAAGGCTGAGGATGGT
 670 G  R  V  S  R  S  S  A  K  V  T  I  N  V  V  D  V  N  D
2521 GGTAGAGTATCACGTTCTTCAAGTGCCAAAGTAACCATAAATGTGGTTGATGTCAATGAC
 690 N  K  P  V  F  I  V  P  P  Y  N  Y  S  Y  E  L  V  L  P  S
2581 AACAAACCAGTTTTCATTGTCCCTCCTTACAACTATTCTTATGAATTGGTTCTACCGTCC
 710 I  N  P  G  T  V  V  F  Q  V  I  A  V  D  N  D  T  G  M  N
```

Figure 2I-3

```
2641 ACTAATCCAGGCACAGTGGTCTTTCAGGTAATTGCTGTTGACAATGACACTGGCATGAAT
 730 A   E   V   R   Y   S   I   V   G   G   N   T   R   D   L   F   A   I   D   Q
2701 GCAGAGGTTCGTTACAGCATTGTAGGAGGAAACACAAGAGATCTGTTTGCAATCGACCAA
 750 E   T   G   N   I   T   L   M   E   K   C   D   V   T   D   L   G   L   H   R
2761 GAAACAGGCAACATAACATTGATGGAGAAATGTGATGTTACAGACCTTGGTTTACACAGA
 770 V   L   V   K   A   N   D   L   G   Q   P   D   S   L   F   S   V   V   I   V
2821 GTGTTGGTCAAAGCTAATGACTTAGGACAGCCTGATTCTCTCTTCAGTGTTGTAATTGTC
 790 N   L   F   V   N   E   S   V   T   N   A   T   L   I   N   E   L   V   R   K
2881 AATCTGTTCGTGAATGAGTCAGTGACCAATGCTACACTGATTAATGAACTGGTGCGCAAA
 810 S   I   E   A   P   V   T   P   N   T   E   I   A   D   V   S   S   P   T   S
2941 AGCATTGAAGCACCAGTGACCCCAAATACTGAGATAGCTGATGTATCCTCACCAACTAGT
 830 D   Y   V   K   I   L   V   A   A   V   A   G   I   T   V   V   V   V   I
3001 GACTATGTCAAGATCCTGGTTGCAGCTGTTGCTGGCACCATAACTGTCGTTGTAGTTATT
 850 F   I   T   A   V   V   R   C   R   Q   A   P   H   L   K   A   A   Q   K   N
3061 TTCATCACTGCTGTAGTAAGATGTCGCCAGGCACCACACCTTAAGGCTGCTCAGAAAAAC
 870 M   Q   N   S   E   W   A   T   P   N   P   E   N   R   Q   M   I   M   M   K
3121 ATGCAGAATTCTGAATGGGCTACCCCAAACCCAGAAAACAGGCAGATGATAATGATGAAG
 890 K   K   K   K   K   K   H   S   P   K   N   L   L   L   N   V   V   T   I
3181 AAAAAGAAAAAGAAGAAGAAGCATTCCCCTAAGAACCTGCTGCTTAATGTTGTCACTATT
 910 E   E   T   K   A   D   D   V   D   S   D   G   N   R   V   T   L   D   L   P
3241 GAAGAAACTAAGGCAGATGATGTTGACAGTGATGGAAACAGAGTCACACTAGACCTTCCT
 930 I   D   L   E   E   Q   T   M   G   K   Y   N   W   V   T   T   P   T   T   F
3301 ATTGATCTAGAAGAGCAAACAATGGGAAAGTACAATTGGGTAACTACACCTACTACTTTC
 950 K   P   D   S   P   D   L   A   R   H   Y   K   S   A   S   P   Q   P   A   F
3361 AAGCCTGACAGCCCTGATTTGGCCCGACACTACAAATCTGCCTCTCCACAGCCTGCCTTC
 970 Q   I   Q   P   E   T   P   L   N   L   K   H   H   I   I   Q   E   L   P   L
3421 CAAATTCAGCCTGAAACTCCCCTGAATTTGAAGCACCACATCATCCAAGAACTGCCTCTC
 990 D   N   T   F   V   A   C   D   S   I   S   N   C   S   S   S   S   D   P
3481 GATAACACCTTTGTGGCCTGTGACTCTATCTCCAATTGTTCCTCAAGCAGTTCAGATCCC
1010 Y   S   V   S   D   C   G   Y   P   V   T   T   F   E   V   P   V   S   H
3541 TACAGCGTTTCTGACTGTGGCTATCCAGTGACAACCTTCGAGGTACCTGTGTCCGTACAC
1030 T   R   P   T   D   S   R   T   *
3601 ACCAGACCGACTGATTCCAGGACATGAactattgaaatctgcagtgagatgtaactttct
3661 aggaacaacaaaattccattccccttccaaaaaatttcaatgattgtgatttcaaaatta
3721 ggctaagatcattaattttgtaatctagatttcccattataaaagcaagcaaaaatcatc
3781 ttaaaaatgatgtcctagtgaaccttgtgctttctttagctgtaatctggcaatggaaat
3841 ttaaaatttatggaagagacagtgcagcgcaataacagagtactctcatgctgtttctct
3901 gtttgctctgaatcaacagccatgatgtaatataaggctgtcttggtgtatacacttatg
3961 gttaatatatcagtcatgaaacatgcaattacttgccctgtctgattgttgaataattaa
4021 aacattatctccaggagtttggaagtgagctgaactagccaaactactctctgaaaggta
4081 tccagggcaagagacatttttaagaccccaaacaaacaaaaaacaaaaccaaaacactct
```

Figure 2I-4

```
4141 ggttcagtgttttgaaaatattgactaacataatattgctgagaaaatcatttttattac
4201 ccaccactctgcttaaaagttgagtgggccgggcgcggtggctcacgcctgtaattccag
4261 cactttgggaggccgaggcgggtggatcacgaggtcaggatattgagaccatcctggcta
4321 acatggtgaaaccccatctccactaaaaatacaaaaaattagctgggcgtggtggcgggc
4381 gcctgtagtcccagctactcgggaggctgaggcaggagaatggcgtgaacccgggaggcg
4441 gagcttgcagtgagccgagatggcgccactgcactccagcctgggtgacagagcaagact
4501 ctgtctcaaaaagaaaaaaatgttcagtgatagaaaataattttactaggtttttatgtt
4561 gattgtactcatgctgttccactccttttaattattaaaaagttattttttggctgggtgt
4621 ggtggctcatacctgtaatcccagcactttgggaggccgaggcgggtggatcacctgagg
4681 tcaggagttcaagaccagtctggccaacat
```

Figure 2J. 109P1D4 v.1, v.2 and v.3 SNP variants. Though these SNP variants are shown separately, they can also occur in any combinations and in any of the transcript variants listed above.

| v.1 | | | | v.2 | | | | v.3** | | | |
|---|---|---|---|---|---|---|---|---|---|---|---|
| SNP_no | Position | Alleles | AA change*** | SNP_no | Position | Alleles | AA change** | SNP_no | Pos. | Alleles | AA change*** |
| 1 | 55 | A/C | | | | | | 1 | 55 | A/C | |
| 2 | 206 | A/G | | | | | | 2 | 206 | A/G | |
| 3 | 223 | C/G | | | | | | 3 | 223 | C/G | |
| 4 | 295 | G/C | | | | | | 4 | 295 | G/C | |
| 5 | 352 | C/T | | | | | | 5 | 352 | C/T | |
| 6 | 400 | A/G | | | | | | 6 | 400 | A/G | |
| 7 | 654 | A/G | | | | | | 7 | 654 | A/G | |
| 8 | 830 | A/C | | 1 | 574 | A/C | V24V | 8 | 830 | A/C | |
| 9 | 889 | C/T | A15V | 2 | 633 | C/T | A44V | 9 | 889 | C/T | A15V |
| 10 | 947 | G/T | M34I | 3 | 691 | G/T | M63I | 10 | 947 | G/T | M34I |
| 11 | 969 | G/A | D42N | 4 | 713 | G/A | D71N | 11 | 969 | G/A | D42N |
| 12 | 1023 | G/A | A60T | 5 | 767 | G/A | A89T | 12 | 1023 | G/A | A60T |
| 13 | 1305 | A/G | I154V | 6 | 1049 | A/G | I183V | 13 | 1305 | A/G | I154V |
| 14 | 1490 | C/T | Y215Y | 7 | 1234 | C/T | Y244Y | 14 | 1490 | C/T | Y215Y |
| 15 | 1556 | G/A | V237V | 8 | 1300 | G/A | V266V | 15 | 1556 | G/A | V237V |
| 16 | 1719 | G/A | V292I | 9 | 1463 | G/A | V321I | 16 | 1719 | G/A | V292I |
| 17 | 2057 | C/T | I404I | 10 | 1801 | C/T | I433I | 17 | 2057 | C/T | I404I |
| 18 | 2104 | C/A | T420N | 11 | 1848 | C/A | T449N | 18 | 2104 | C/A | T420N |
| 19 | 2302 | C/T | T486M | 12 | 2046 | C/T | T515M | 19 | 2302 | C/T | T486M |
| 20 | 2317 | T/C | M491T | 13 | 2061 | T/C | M520T | 20 | 2317 | T/C | M491T |
| 21 | 2343 | A/G | K500E | 14 | 2087 | A/G | K529E | 21 | 2343 | A/G | K500E |
| 22 | 2394 | T/C | C517R | 15 | 2138 | T/C | C546R | 22 | 2394 | T/C | C517R |
| 23 | 2480 | C/T | N545N | 16 | 2224 | C/T | N574N | 23 | 2480 | C/T | N545N |
| 24 | 2573 | C/A | N576K | 17 | 2317 | C/A | N605K | 24 | 2573 | C/A | N576K |
| 25 | 2878 | C/A | S678Y | 18 | 2622 | C/A | S707Y | 25 | 2878 | C/A | S678Y |
| 26 | 2884 | G/A | C680Y | 19 | 2628 | G/A | C709Y | 26 | 2884 | G/A | C680Y |
| 27 | 3170 | G/A | S775S | 20 | 2914 | G/A | S804S | 27 | 3170 | G/A | S775S |
| 28 | 3214 | C/T | T790I | 21 | 2958 | C/T | T819I | 28 | 3214 | C/T | T790I |
| 29 | 3391 | A/T | K849M | 22 | 3135 | A/T | K878M | 29 | 3391 | A/T | K849M |
| 30 | 3486 | T/C | L881L | 23 | 3230 | T/C | L910L | 30 | 3486 | T/C | L881L |
| 31 | 3498 | T/G | F885V | 24 | 3242 | T/G | F914V | 31 | 3498 | T/G | F885V |
| 32 | 3635 | C/T | P930P | 25 | 3379 | C/T | P959P | 32 | 3635 | C/T | P930P |
| 33 | 3718 | C/T | S958L | 26 | 3462 | C/T | S987L | 33 | 3718 | C/T | S958L |
| 34 | 3785 | G/T | K980N | 27 | 3529 | G/T | K1009N | 34 | 3785 | G/T | K980N |
| 35 | 3842 | G/A | T999T | 28 | 3586 | G/A | T1028T | 35 | 3842 | G/A | T999T |
| 36 | 3924 | T/G | | 29 | 3639 | C/G | S1046S TOP* | 36 | 3898 | G/A | R1018Q* |
| 37 | 3947 | C/T | | 30 | 3664 | A/G | I1054M* | 37 | 4337 | G/A | S1164S* |
| 38 | 4146 | G/A | | 31 | 3714 | T/C | * | 38 | 4408 | G/C | R1188P* |
| 39 | 4206 | T/G | | 32 | 3882 | A/G | * | 39 | 4426 | C/T | A1194V* |
| 40 | 4351 | T/A | | 33 | 4176 | C/G | * | 40 | 4483 | C/T | P1213L* |
| 41 | 4452 | C/A | | 34 | 4378 | T/A | * | 41 | 4528 | C/G | A1228G* |
| | | | | 35 | 4383 | T/C | * | 42 | 4623 | C/T | P1260S* |
| | | | | 36 | 4499 | T/C | * | 43 | 4704 | G/A | D1287N* |
| | | | | 37 | 4508 | A/G | * | 44 | 4709 | G/A | G1288G* |
| | | | | 38 | 4515 | T/C | * | 45 | 4728 | G/C | G1295R* |
| | | | | 39 | 4676 | T/C | * | 46 | 4824 | A/G | T1327A* |
| | | | | | | | | 47 | 4875 | G/A | E1344K* |
| | | | | | | | | 48 | 4876 | A/C | K1344T* |
| | | | | | | | | 49 | 4875-6 | GA/AC | A1344T* |

*Note: SNP not corresponding to those in v.1

Figure 2J-2

**Note: more SNP in the 3' untranslated region are as following: 5151 C/T, 5318 C/T, 5350 T/G, 5357 T/C, 5377 T/G, 5424 G/A, 5651 T/C, 5695 G/A, 5705 C/A, 5889 G/A, 5948 T/C, 5998 C/A, 6136 C/G, 6250 T/C, 6274 G/T, 6342 A/G, 6579 A/T, 6580 C/T, 6711 T/A, 6748 G/T, 6863 T/C, 6906 T/G, 7058 A/C, 7306 C/A, 7565 C/T, 7578 G/C, 7627 C/T, 7700 T/C, 7725 C/G, 7728 A/T, 7734 A/G, 7789 G/A, 7815 C/T, 8315 C/T, 8331 C/A, 8430 G/A, 8572 C/T, 8593 C/T, 8608 G/A, 8862 T/C and 9030 C/G.
***Note: Amino acid that does not change is omitted.

Figure 2K. 109P1D4 v.6, v.7 and v.8 SNP variants. Though these SNP variants are shown separately, they can also occur in any combinations and in any of the transcript variants listed above.

| v.6 | | | | v.7 | | | | v.8** | | | |
|---|---|---|---|---|---|---|---|---|---|---|---|
| SNP_no | Position | Alleles | AA change*** | SNP_no | Position | Alleles | AA change*** | SNP_no | Position | Alleles | AA change*** |
| | | | | 1 | 204 | G/A | * | 1 | 204 | G/A | * |
| | | | | 2 | 221 | C/G | * | 2 | 221 | C/G | * |
| | | | | 3 | 293 | C/G | * | 3 | 293 | C/G | * |
| | | | | 4 | 350 | T/C | * | 4 | 350 | T/C | * |
| | | | | 5 | 398 | G/A | * | 5 | 398 | G/A | * |
| 1 | 597 | T/A | | 6 | 652 | G/A | * | 6 | 652 | G/A | * |
| 2 | 720 | T/C | V36A | 7 | 874 | T/C | V47A | 7 | 874 | T/C | V47A |
| 3 | 778 | T/G | I55M | 8 | 932 | T/G | I66M | 8 | 932 | T/G | I66M |
| 4 | 800 | A/G | N63D | 9 | 954 | A/G | N74D | 9 | 954 | A/G | N74D |
| 5 | 854 | A/G | T81A | 10 | 1008 | A/G | T92A | 10 | 1008 | A/G | T92A |
| 6 | 937 | C/T | T108T | 11 | 1091 | C/T | T119T | 11 | 1091 | C/T | T119T |
| 7 | 1136 | A/G | I175V | 12 | 1290 | A/G | I186V | 12 | 1290 | A/G | I186V |
| 8 | 1321 | T/C | Y236Y | 13 | 1475 | T/C | Y247Y | 13 | 1475 | T/C | Y247Y |
| 9 | 1387 | A/G | V258V | 14 | 1541 | A/G | V269V | 14 | 1541 | A/G | V269V |
| 10 | 1550 | G/A | V313I | 15 | 1704 | G/A | V324I | 15 | 1704 | G/A | V324I |
| 11 | 1888 | T/C | I425I | 16 | 2042 | T/C | I436I | 16 | 2042 | T/C | I436I |
| 12 | 1935 | A/C | N441T | 17 | 2089 | A/C | N452T | 17 | 2089 | A/C | N452T |
| 13 | 2133 | T/C | M507T | 18 | 2287 | T/C | M518T | 18 | 2287 | T/C | M518T |
| 14 | 2148 | C/T | T512M | 19 | 2302 | C/T | T523M | 19 | 2302 | C/T | T523M |
| 15 | 2174 | G/A | E521K | 20 | 2328 | G/A | E532K | 20 | 2328 | G/A | E532K |
| 16 | 2225 | C/T | R538C | 21 | 2379 | C/T | R549C | 21 | 2379 | C/T | R549C |
| 17 | 2311 | C/T | N566N | 22 | 2465 | C/T | N577N | 22 | 2465 | C/T | N577N |
| 18 | 2404 | A/C | K597N | 23 | 2558 | A/C | K608N | 23 | 2558 | A/C | K608N |
| 19 | 2709 | A/C | Y699S | 24 | 2863 | A/C | Y710S | 24 | 2863 | A/C | Y710S |
| 20 | 2715 | A/G | Y701C | 25 | 2869 | A/G | Y712C | 25 | 2869 | A/G | Y712C |
| 21 | 3001 | A/G | S796S | 26 | 3155 | A/G | S807S | 26 | 3155 | A/G | S807S |
| 22 | 3045 | T/C | I811T | 27 | 3199 | T/C | I822T | 27 | 3199 | T/C | I822T |
| 23 | 3222 | T/A | M870K | 28 | 3376 | T/A | M881K | 28 | 3376 | T/A | M881K |
| 24 | 3317 | C/T | L902L | 29 | 3471 | C/T | L913L | 29 | 3471 | C/T | L913L |
| 25 | 3329 | T/G | F906V | 30 | 3483 | G/T | V917F | 30 | 3483 | G/T | V917F |
| 26 | 3466 | T/C | P951P | 31 | 3620 | T/C | P962P | 31 | 3620 | T/C | P962P |
| 27 | 3549 | T/C | L979S | 32 | 3703 | T/C | L990S | 32 | 3703 | T/C | L990S |
| 28 | 3616 | G/T | K1001N | 33 | 3770 | T/G | N1012K | 33 | 3770 | T/G | N1012K |
| 29 | 3673 | A/G | T1020T | 34 | 3827 | A/G | T1031T | 34 | 3827 | A/G | T1031T |
| 30 | 3726 | G/C | Stop1038S | 35 | 3880 | G/C | Stop1049S | 35 | 4205 | A/G | S1157S* |
| 31 | 3751 | G/A | M1046I | 36 | 3905 | G/A | M1057I | 36 | 4276 | C/G | P1181R* |
| 32 | 3801 | T/C | | 37 | 3955 | T/C | | 37 | 4294 | T/C | V1187A* |
| 33 | 3970 | A/G | | 38 | 4123 | G/A | | 38 | 4351 | C/T | P1206L* |
| 34 | 4265 | C/G | | 39 | 4417 | G/C | | 39 | 4396 | G/C | G1221A* |
| | | | | | | | | 40 | 4491 | T/C | S1253P* |
| | | | | | | | | 41 | 4572 | A/G | N1280D* |
| | | | | | | | | 42 | 4577 | A/G | G1281G* |
| | | | | | | | | 43 | 4596 | G/C | G1288R* |
| | | | | | | | | 44 | 4692 | G/A | A1320T* |
| | | | | | | | | 45 | 4743 | A/G | T1337A* |
| | | | | | | | | 46 | 4744 | C/A | T1337K* |
| | | | | | | | | 47 | 4743-4 | AC/GA | T1337E* |

*Note: SNP not corresponding to those in v.6

Figure 2K-2

**Note: more SNP in the 3' untranslated region are as following: 5019 T/C, 5186 T/C, 5218 G/T, 5225 T/C, 5245 G/T, 5292 A/G, 5519 C/T, 5563 A/G, 5573 A/C, 5757 G/A, 5816 C/T, 5866 C/A, 6004 G/C, 6118 C/T, 6142 T/G, 6210 G/A, 6441 T/A, 6442 T/C, 6573 A/T, 6610 T/G, 6725 C/T, 6768 G/T, 6994 G/T, 7176 A/C, 7428 T/C, 7441 C/G, 7490 T/C, 7563 C/T, 7588 G/C, 7591 A/T, 7597 G/A, 7652 A/G, 7678 T/C, 8179 T/C, 8195 A/C, 8294 A/G, 8432 T/C, 8453 T/C, 8468 A/G, 8722 C/T and 8890 G/C

***Note: Amino acid that does not change is omitted.

Figure 3:

Figure 3A. Amino acid sequence 109P1D4 v.1 (SEQ ID NO: 20). The 109P1D4 v.1 protein has 1021 amino acids.

```
   1 MDLLSGTYIF AVLLACVVFH SGAQEKNYTI REEMPENVLI GDLLKDLNLS LIPNKSLTTA
  61 MQFKLVYKTG DVPLIRIEED TGEIFTTGAR IDREKLCAGI PRDEHCFYEV EVAILPDEIF
 121 RLVKIRFLIE DINDNAPLFP ATVINISIPE NSAINSKYTL PAAVDPDVGI NGVQNYELIK
 181 SQNIFGLDVI ETPEGDKMPQ LIVQKELDRE EKDTYVMKVK VEDGGFPQRS STAILQVSVT
 241 DTNDNHPVFK ETEIEVSIPE NAPVGTSVTQ LHATDADIGE NAKIHFSFSN LVSNIARRLF
 301 HLNATTGLIT IKEPLDREET PNHKLLVLAS DGGLMPARAM VLVNVTDVND NVPSIDIRYI
 361 VNPVNDTVVL SENIPLNTKI ALITVTDKDA DHNGRVTCFT DHEIPFRLRP VFSNQFLLET
 421 AAYLDYESTK EYAIKLLAAD AGKPPLNQSA MLFIKVKDEN DNAPVFTQSF VTVSIPENNS
 481 PGIQLTKVSA MDADSGPNAK INYLLGPDAP PEFSLDCRTG MLTVVKKLDR EKEDKYLFTI
 541 LAKDNGVPPL TSNVTVFVSI IDQNDNSPVF THNEYNFYVP ENLPRHGTVG LITVTDPDYG
 601 DNSAVTLSIL DENDDFTIDS QTGVIRPNIS FDREKQESYT FYVKAEDGGR VSRSSSAKVT
 661 INVVDVNDNK PVFIVPPSNC SYELVLPSTN PGTVVFQVIA VDNDTGMNAE VRYSIVGGNT
 721 RDLFAIDQET GNITLMEKCD VTDLGLHRVL VKANDLGQPD SLFSVVIVNL FVNESVTNAT
 781 LINELVRKST EAPVTPNTEI ADVSSPTSDY VKILVAAVAG TITVVVVIFI TAVVRCRQAP
 841 HLKAAQKNKQ NSEWATPNPE NRQMIMMKKK KKKKKHSPKN LLLNFVTIEE TKADDVDSDG
 901 NRVTLDLPID LEEQTMGKYN WVTTPTTFKP DSPDLARHYK SASPQPAFQI QPETPLNSKH
 961 HIIQELPLDN TFVACDSISK CSSSSSDPYS VSDCGYPVTT FEVPVSVHTR PVGIQVSNTT
1021 F
```

Figure 3B. Amino acid sequence 109P1D4 v.2 (SEQ ID NO:21). The 109P1D4 v.2 protein has 1054 amino acids.

```
   1 MRTERQWVLI QIFQVLCGLI QQTVTSVPGM DLLSGTYIFA VLLACVVFHS GAQEKNYTIR
  61 EEMPENVLIG DLLKDLNLSL IPNKSLTTAM QFKLVYKTGD VPLIRIEEDT GEIFTTGARI
 121 DREKLCAGIP RDEHCFYEVE VAILPDEIFR LVKIRFLIED INDNAPLFPA TVINISIPEN
 181 SAINSKYTLP AAVDPDVGIN GVQNYELIKS QNIFGLDVIE TPEGDKMPQL IVQKELDREE
 241 KDTYVMKVKV EDGGFPQRSS TAILQVSVTD TNDNHPVFKE TEIEVSIPEN APVGTSVTQL
 301 HATDADIGEN AKIHFSFSNL VSNIARRLFH LNATTGLITI KEPLDREETP NHKLLVLASD
 361 GGLMPARAMV LVNVTDVNDN VPSIDIRYIV NPVNDTVVLS ENIPLNTKIA LITVTDKDAD
 421 HNGRVTCFTD HEIPFRLRPV FSNQFLLETA AYLDYESTKE YAIKLLAADA GKPPLNQSAM
 481 LFIKVKDEND NAPVFTQSFV TVSIPENNSP GIQLTKVSAM DADSGPNAKI NYLLGPDAPP
 541 EFSLDCRTGM LTVVKKLDRE KEDKYLFTIL AKDNGVPPLT SNVTVFVSII DQNDNSPVFT
 601 HNEYNFYVPE NLPRHGTVGL ITVTDPDYGD NSAVTLSILD ENDDFTIDSQ TGVIRPNISF
 661 DREKQESYTF YVKAEDGGRV SRSSSAKVTI NVVDVNDNKP VFIVPPSNCS YELVLPSTNP
 721 GTVVFQVIAV DNDTGMNAEV RYSIVGGNTR DLFAIDQETG NITLMEKCDV TDLGLHRVLV
 781 KANDLGQPDS LFSVVIVNLF VNESVTNATL INELVRKSTE APVTPNTEIA DVSSPTSDYV
 841 KILVAAVAGT ITVVVIFIT AVVRCRQAPH LKAAQKNKQN SEWATPNPEN RQMIMMKKKK
 901 KKKKHSPKNL LLNFVTIEET KADDVDSDGN RVTLDLPIDL EEQTMGKYNW VTTPTTFKPD
 961 SPDLARHYKS ASPQPAFQIQ PETPLNSKHH IIQELPLDNT FVACDSISKC SSSSSDPYSV
1021 SDCGYPVTTF EVPVSVHTRP TDSRTSTIEI CSEI
```

Figure 3C. Amino acid sequence 109P1D4 v.3 (SEQ ID NO:22). The 109P1D4 v.3 protein has 1347 amino acids.

```
   1 MDLLSGTYIF AVLLACVVFH SGAQEKNYTI REEMPENVLI GDLLKDLNLS LIPNKSLTTA
  61 MQFKLVYKTG DVPLIRIEED TGEIFTTGAR IDREKLCAGI PRDEHCFYEV EVAILPDEIF
 121 RLVKIRFLIE DINDNAPLFP ATVINISIPE NSAINSKYTL PAAVDPDVGI NGVQNYELIK
 181 SQNIFGLDVI ETPEGDKMPQ LIVQKELDRE EKDTYVMKVK VEDGGFPQRS STAILQVSVT
 241 DTNDNHPVFK ETEIEVSIPE NAPVGTSVTQ LHATDADIGE NAKIHFSFSN LVSNIARRLF
 301 HLNATTGLIT IKEPLDREET PNHKLLVLAS DGGLMPARAM VLVNVTDVND NVPSIDIRYI
 361 VNPVNDTVVL SENIPLNTKI ALITVTDKDA DHNGRVTCFT DHEIPFRLRP VFSNQFLLET
 421 AAYLDYESTK EYAIKLLAAD AGKPPLNQSA MLFIKVKDEN DNAPVFTQSF VTVSIPENNS
 481 PGIQLTKVSA MDADSGPNAK INYLLGPDAP PEFSLDCRTG MLTVVKKLDR EKEDKYLFTI
 541 LAKDNGVPPL TSNVTVFVSI IDQNDNSPVF THNEYNFYVP ENLPRHGTVG LITVTDPDYG
 601 DNSAVTLSIL DENDDFTIDS QTGVIRPNIS FDREKQESYT FYVKAEDGGR VSRSSSAKVT
 661 INVVDVNDNK PVFIVPPSNC SYELVLPSTN PGTVVFQVIA VDNDTGMNAE VRYSIVGGNT
 721 RDLFAIDQET GNITLMEKCD VTDLGLHRVL VKANDLGQPD SLFSVVIVNL FVNESVTNAT
 781 LINELVRKST EAPVTPNTEI ADVSSPTSDY VKILVAAVAG TITVVVIFI TAVVRCRQAP
 841 HLKAAQKNKQ NSEWATPNPE NRQMIMMKKK KKKKKHSPKN LLLNFVTIEE TKADDVDSDG
 901 NRVTLDLPID LEEQTMGKYN WVTTPTTFKP DSPDLARHYK SASPQPAFQI QPETPLNSKH
 961 HIIQELPLDN TFVACDSISK CSSSSSDPYS VSDCGYPVTT FEVPVSVHTR PPMKEVVRSC
1021 TPMKESTTME IWIHPQPQRK SEGKVAGKSQ RRVTFHLPEG SQESSSDGGL GDHDAGSLTS
1081 TSHGLPLGYP QEEYFDRATP SNRTEGDGNS DPESTFIPGL KKAAEITVQP TVEEASDNCT
1141 QECLIYGHSD ACWMPASLDH SSSSQAQASA LCHSPPLSQA STQHHSPRVT QTIALCHSPP
1201 VTQTIALCHS PPPIQVSALH HSPPLVQATA LHHSPPSAQA SALCYSPPLA QAAAISHSSP
1261 LPQVIALHRS QAQSSVSLQQ GWVQGADGLC SVDQGVQGSA TSQFYTMSER LHPSDDSIKV
1321 IPLTTFTPRQ QARPSRGDSP IMEEHPL
```

Figure 3D. Amino acid sequence 109P1D4 v.4 (SEQ ID NO:23). The 109P1D4 v.4 protein has 1337 amino acids.

```
   1 MDLLSGTYIF AVLLACVVFH SGAQEKNYTI REEMPENVLI GDLLKDLNLS LIPNKSLTTA
  61 MQFKLVYKTG DVPLIRIEED TGEIFTTGAR IDREKLCAGI PRDEHCFYEV EVAILPDEIF
 121 RLVKIRFLIE DINDNAPLFP ATVINISIPE NSAINSKYTL PAAVDPDVGI NGVQNYELIK
 181 SQNIFGLDVI ETPEGDKMPQ LIVQKELDRE EKDTYVMKVK VEDGGFPQRS STAILQVSVT
 241 DTNDNHPVFK ETEIEVSIPE NAPVGTSVTQ LHATDADIGE NAKIHFSFSN LVSNIARRLF
 301 HLNATTGLIT IKEPLDREET PNHKLLVLAS DGGLMPARAM VLVNVTDVND NVPSIDIRYI
 361 VNPVNDTVVL SENIPLNTKI ALITVTDKDA DHNGRVTCFT DHEIPFRLRP VFSNQFLLET
 421 AAYLDYESTK EYAIKLLAAD AGKPPLNQSA MLFIKVKDEN DNAPVFTQSF VTVSIPENNS
 481 PGIQLTKVSA MDADSGPNAK INYLLGPDAP PEFSLDCRTG MLTVVKKLDR EKEDKYLFTI
 541 LAKDNGVPPL TSNVTVFVSI IDQNDNSPVF THNEYNFYVP ENLPRHGTVG LITVTDPDYG
 601 DNSAVTLSIL DENDDFTIDS QTGVIRPNIS FDREKQESYT FYVKAEDGGR VSRSSSAKVT
 661 INVVDVNDNK PVFIVPPSNC SYELVLPSTN PGTVVFQVIA VDNDTGMNAE VRYSIVGGNT
 721 RDLFAIDQET GNITLMEKCD VTDLGLHRVL VKANDLGQPD SLFSVVIVNL FVNESVTNAT
 781 LINELVRKST EAPVTPNTEI ADVSSPTSDY VKILVAAVAG TITVVVIFI TAVVRCRQAP
 841 HLKAAQKNKQ NSEWATPNPE NRQMIMMKKK KKKKKHSPKN LLLNFVTIEE TKADDVDSDG
 901 NRVTLDLPID LEEQTMGKYN WVTTPTTFKP DSPDLARHYK SASPQPAFQI QPETPLNSKH
```

Figure 3D-2
```
 961 HIIQELPLDN TFVACDSISK CSSSSSDPYS VSDCGYPVTT FEVPVSVHTR PPMKEVVRSC
1021 TPMKESTTME IWIHPQPQSQ RRVTFHLPEG SQESSSDGGL GDHDAGSLTS TSHGLPLGYP
1081 QEEYFDRATP SNRTEGDGNS DPESTFIPGL KKAAEITVQP TVEEASDNCT QECLIYGHSD
1141 ACWMPASLDH SSSSQAQASA LCHSPPLSQA STQHHSPRVT QTIALCHSPP VTQTIALCHS
1201 PPPIQVSALH HSPPLVQATA LHHSPPSAQA SALCYSPPLA QAAAISHSSP LPQVIALHRS
1261 QAQSSVSLQQ GWVQGADGLC SVDQGVQGSA TSQFYTMSER LHPSDDSIKV IPLTTFTPRQ
1321 QARPSRGDSP IMEEHPL
```

Figure 3E. Amino acid sequence 109P1D4 v.5 (SEQ ID NO: 24). The 109P1D4 v.5 protein has 1310 amino acids.
```
   1 MDLLSGTYIF AVLLACVVFH SGAQEKNYTI REEMPENVLI GDLLKDLNLS LIPNKSLTTA
  61 MQFKLVYKTG DVPLIRIEED TGEIFTTGAR IDREKLCAGI PRDEHCFYEV EVAILPDEIF
 121 RLVKIRFLIE DINDNAPLFP ATVINISIPE NSAINSKYTL PAAVDPDVGI NGVQNYELIK
 181 SQNIFGLDVI ETPEGDKMPQ LIVQKELDRE EKDTYVMKVK VEDGGFPQRS STAILQVSVT
 241 DTNDNHPVFK ETEIEVSIPE NAPVGTSVTQ LHATDADIGE NAKIHFSFSN LVSNIARRLF
 301 HLNATTGLIT IKEPLDREET PNHKLLVLAS DGGLMPARAM VLVNVTDVND NVPSIDIRYI
 361 VNPVNDTVVL SENIPLNTKI ALITVTDKDA DHNGRVTCFT DHEIPFRLRP VFSNQFLLET
 421 AAYLDYESTK EYAIKLLAAD AGKPPLNQSA MLFIKVKDEN DNAPVFTQSF VTVSIPENNS
 481 PGIQLTKVSA MDADSGPNAK INYLLGPDAP PEFSLDCRTG MLTVVKKLDR EKEDKYLFTI
 541 LAKDNGVPPL TSNVTVFVSI IDQNDNSPVF THNEYNFYVP ENLPRHGTVG LITVTDPDYG
 601 DNSAVTLSIL DENDDFTIDS QTGVIRPNIS FDREKQESYT FYVKAEDGGR VSRSSSAKVT
 661 INVVDVNDNK PVFIVPPSNC SYELVLPSTN PGTVVFQVIA VDNDTGMNAE VRYSIVGGNT
 721 RDLFAIDQET GNITLMEKCD VTDLGLHRVL VKANDLGQPD SLFSVVIVNL FVNESVTNAT
 781 LINELVRKST EAPVTPNTEI ADVSSPTSDY VKILVAAVAG TITVVVIFI TAVVRCRQAP
 841 HLKAAQKNKQ NSEWATPNPE NRQMIMMKKK KKKKKHSPKN LLLNFVTIEE TKADDVDSDG
 901 NRVTLDLPID LEEQTMGKYN WVTTPTTFKP DSPDLARHYK SASPQPAFQI QPETPLNSKH
 961 HIIQELPLDN TFVACDSISK CSSSSSDPYS VSDCGYPVTT FEVPVSVHTR PSQRRVTFHL
1021 PEGSQESSSD GGLGDHDAGS LTSTSHGLPL GYPQEEYFDR ATPSNRTEGD GNSDPESTFI
1081 PGLKKAAEIT VQPTVEEASD NCTQECLIYG HSDACWMPAS LDHSSSSQAQ ASALCHSPPL
1141 SQASTQHHSP RVTQTIALCH SPPVTQTIAL CHSPPPIQVS ALHHSPPLVQ ATALHHSPPS
1201 AQASALCYSP PLAQAAAISH SSPLPQVIAL HRSQAQSSVS LQQGWVQGAD GLCSVDQGVQ
1261 GSATSQFYTM SERLHPSDDS IKVIPLTTFT PRQQARPSRG DSPIMEEHPL
```

Figure 3F. Amino acid sequence 109P1D4 v.6 (SEQ ID NO: 25). The 109P1D4 v.6 protein has 1037 amino acids.
```
   1 MTVGFNSDIS SVVRVNTTNC HKCLLSGTYI FAVLLCVVF HSGAQEKNYT IREEIPENVL
  61 IGNLLKDLNL SLIPNKSLTT TMQFKLVYKT GDVPLIRIEE DTGEIFTTGA RIDREKLCAG
 121 IPRDEHCFYE VEVAILPDEI FRLVKIRFLI EDINDNAPLF PATVINISIP ENSAINSKYT
 181 LPAAVDPDVG INGVQNYELI KSQNIFGLDV IETPEGDKMP QLIVQKELDR EEKDTYVMKV
 241 KVEDGGFPQR SSTAILQVSV TDTNDNHPVF KETEIEVSIP ENAPVGTSVT QLHATDADIG
 301 ENAKIHFSFS NLVSNIARRL FHLNATTGLI TIKEPLDREE TPNHKLLVLA SDGGLMPARA
 361 MVLVNVTDVN DNVPSIDIRY IVNPVNDTVV LSENIPLNTK IALITVTDKD ADHNGRVTCF
```

Figure 3F-2

```
 421 TDHEIPFRLR PVFSNQFLLE NAAYLDYEST KEYAIKLLAA DAGKPPLNQS AMLFIKVKDE
 481 NDNAPVFTQS FVTVSIPENN SPGIQLMKVS ATDADSGPNA EINYLLGPDA PPEFSLDRRT
 541 GMLTVVKKLD REKEDKYLFT ILAKDNGVPP LTSNVTVFVS IIDQNDNSPV FTHNEYKFYV
 601 PENLPRHGTV GLITVTDPDY GDNSAVTLSI LDENDDFTID SQTGVIRPNI SFDREKQESY
 661 TFYVKAEDGG RVSRSSSAKV TINVVDVNDN KPVFIVPPYN YSYELVLPST NPGTVVFQVI
 721 AVDNDTGMNA EVRYSIVGGN TRDLFAIDQE TGNITLMEKC DVTDLGLHRV LVKANDLGQP
 781 DSLFSVVIVN LFVNESVTNA TLINELVRKS IEAPVTPNTE IADVSSPTSD YVKILVAAVA
 841 GTITVVVVIF ITAVVRCRQA PHLKAAQKNM QNSEWATPNP ENRQMIMMKK KKKKKKHSPK
 901 NLLLNFVTIE ETKADDVDSD GNRVTLDLPI DLEEQTMGKY NWVTTPTTFK PDSPDLARHY
 961 KSASPQPAFQ IQPETPLNLK HHIIQELPLD NTFVACDSIS KCSSSSSDPY SVSDCGYPVT
1021 TFEVPVSVHT RPTDSRT
```

Figure 3G. Amino acid sequence 109P1D4 v.7 (SEQ ID NO: 26). The 109P1D4 v.7 protein has 1048 amino acids.

```
   1 MFRVGFLIIS SSSSLSPLLL VSVVRVNTTN CHKCLLSGTY IFAVLLVCVV FHSGAQEKNY
  61 TIREEIPENV LIGNLLKDLN LSLIPNKSLT TTMQFKLVYK TGDVPLIRIE EDTGEIFTTG
 121 ARIDREKLCA GIPRDEHCFY EVEVAILPDE IFRLVKIRFL IEDINDNAPL FPATVINISI
 181 PENSAINSKY TLPAAVDPDV GINGVQNYEL IKSQNIFGLD VIETPEGDKM PQLIVQKELD
 241 REEKDTYVMK VKVEDGGFPQ RSSTAILQVS VTDTNDNHPV FKETEIEVSI PENAPVGTSV
 301 TQLHATDADI GENAKIHFSF SNLVSNIARR LFHLNATTGL ITIKEPLDRE ETPNHKLLVL
 361 ASDGGLMPAR AMVLVNVTDV NDNVPSIDIR YIVNPVNDTV VLSENIPLNT KIALITVTDK
 421 DADHNGRVTC FTDHEIPFRL RPVFSNQFLL ENAAYLDYES TKEYAIKLLA ADAGKPPLNQ
 481 SAMLFIKVKD ENDNAPVFTQ SFVTVSIPEN NSPGIQLMKV SATDADSGPN AEINYLLGPD
 541 APPEFSLDRR TGMLTVVKKL DREKEDKYLF TILAKDNGVP PLTSNVTVFV SIIDQNDNSP
 601 VFTHNEYKFY VPENLPRHGT VGLITVTDPD YGDNSAVTLS ILDENDDFTI DSQTGVIRPN
 661 ISFDREKQES YTFYVKAEDG GRVSRSSSAK VTINVVDVND NKPVFIVPPY NYSYELVLPS
 721 TNPGTVVFQV IAVDNDTGMN AEVRYSIVGG NTRDLFAIDQ ETGNITLMEK CDVTDLGLHR
 781 VLVKANDLGQ PDSLFSVVIV NLFVNESVTN ATLINELVRK SIEAPVTPNT EIADVSSPTS
 841 DYVKILVAAV AGTITVVVVI FITAVVRCRQ APHLKAAQKN MQNSEWATPN PENRQMIMMK
 901 KKKKKKHSP KNLLLNVVTI EETKADDVDS DGNRVTLDLP IDLEEQTMGK YNWVTTPTTF
 961 KPDSPDLARH YKSASPQPAF QIQPETPLNL KHHIIQELPL DNTFVACDSI SNCSSSSSDP
1021 YSVSDCGYPV TTFEVPVSVH TRPTDSRT
```

Figure 3H. Amino acid sequence 109P1D4 v.8 (SEQ ID NO: 27). The 109P1D4 v.8 protein has 1340 amino acids.

```
   1 MFRVGFLIIS SSSSLSPLLL VSVVRVNTTN CHKCLLSGTY IFAVLLVCVV FHSGAQEKNY
  61 TIREEIPENV LIGNLLKDLN LSLIPNKSLT TTMQFKLVYK TGDVPLIRIE EDTGEIFTTG
 121 ARIDREKLCA GIPRDEHCFY EVEVAILPDE IFRLVKIRFL IEDINDNAPL FPATVINISI
 181 PENSAINSKY TLPAAVDPDV GINGVQNYEL IKSQNIFGLD VIETPEGDKM PQLIVQKELD
 241 REEKDTYVMK VKVEDGGFPQ RSSTAILQVS VTDTNDNHPV FKETEIEVSI PENAPVGTSV
 301 TQLHATDADI GENAKIHFSF SNLVSNIARR LFHLNATTGL ITIKEPLDRE ETPNHKLLVL
 361 ASDGGLMPAR AMVLVNVTDV NDNVPSIDIR YIVNPVNDTV VLSENIPLNT KIALITVTDK
```

Figure 3H-2

```
 421 DADHNGRVTC FTDHEIPFRL RPVFSNQFLL ENAAYLDYES TKEYAIKLLA ADAGKPPLNQ
 481 SAMLFIKVKD ENDNAPVFTQ SFVTVSIPEN NSPGIQLMKV SATDADSGPN AEINYLLGPD
 541 APPEFSLDRR TGMLTVVKKL DREKEDKYLF TILAKDNGVP PLTSNVTVFV SIIDQNDNSP
 601 VFTHNEYKFY VPENLPRHGT VGLITVTDPD YGDNSAVTLS ILDENDDFTI DSQTGVIRPN
 661 ISFDREKQES YTFYVKAEDG GRVSRSSSAK VTINVVDVND NKPVFIVPPY NYSYELVLPS
 721 TNPGTVVFQV IAVDNDTGMN AEVRYSIVGG NTRDLFAIDQ ETGNITLMEK CDVTDLGLHR
 781 VLVKANDLGQ PDSLFSVVIV NLFVNESVTN ATLINELVRK SIEAPVTPNT EIADVSSPTS
 841 DYVKILVAAV AGTITVVVVI FITAVVRCRQ APHLKAAQKN MQNSEWATPN PENRQMIMMK
 901 KKKKKKKHSP KNLLLNVVTI EETKADDVDS DGNRVTLDLP IDLEEQTMGK YNWVTTPTTF
 961 KPDSPDLARH YKSASPQPAF QIQPETPLNL KHHIIQELPL DNTFVACDSI SNCSSSSSDP
1021 YSVSDCGYPV TTFEVPVSVH TRPSQRRVTF HLPEGSQESS SDGGLGDHDA GSLTSTSHGL
1081 PLGYPQEEYF DRATPSNRTE GDGNSDPEST FIPGLKKEIT VQPTVEEASD NCTQECLIYG
1141 HSDACWMPAS LDHSSSSQAQ ASALCHSPPL SQASTQHHSP PVTQTIVLCH SPPVTQTIAL
1201 CHSPPPIQVS ALHHSPPLVQ GTALHHSPPS AQASALCYSP PLAQAAAISH SSSLPQVIAL
1261 HRSQAQSSVS LQQGWVQGAN GLCSVDQGVQ GSATSQFYTM SERLHPSDDS IKVIPLTTFA
1321 PRQQARPSRG DSPIMETHPL
```

Figure 3I. Amino acid sequence 109P1D4 v.9 (SEQ ID NO: 28). The 109P1D4 v.9 protein has 1037 amino acids.

```
   1 MTVGFNSDIS SVVRVNTTNC HKCLLSGTYI FAVLLVCVVF HSGAQEKNYT IREEIPENVL
  61 IGNLLKDLNL SLIPNKSLTT TMQFKLVYKT GDVPLIRIEE DTGEIFTTGA RIDREKLCAG
 121 IPRDEHCFYE VEVAILPDEI FRLVKIRFLI EDINDNAPLF PATVINISIP ENSAINSKYT
 181 LPAAVDPDVG INGVQNYELI KSQNIFGLDV IETPEGDKMP QLIVQKELDR EEKDTYVMKV
 241 KVEDGGFPQR SSTAILQVSV TDTNDNHPVF KETEIEVSIP ENAPVGTSVT QLHATDADIG
 301 ENAKIHFSFS NLVSNIARRL FHLNATTGLI TIKEPLDREE TPNHKLLVLA SDGGLMPARA
 361 MVLVNVTDVN DNVPSIDIRY IVNPVNDTVV LSENIPLNTK IALITVTDKD ADHNGRVTCF
 421 TDHEIPFRLR PVFSNQFLLE NAAYLDYEST KEYAIKLLAA DAGKPPLNQS AMLFIKVKDE
 481 NDNAPVFTQS FVTVSIPENN SPGIQLMKVS ATDADSGPNA EINYLLGPDA PPEFSLDRRT
 541 GMLTVVKKLD REKEDKYLFT ILAKDNGVPP LTSNVTVFVS IIDQNDNSPV FTHNEYKFYV
 601 PENLPRHGTV GLITVTDPDY GDNSAVTLSI LDENDDFTID SQTGVIRPNI SFDREKQESY
 661 TFYVKAEDGG RVSRSSSAKV TINVVDVNDN KPVFIVPPYN YSYELVLPST NPGTVVFQVI
 721 AVDNDTGMNA EVRYSIVGGN TRDLFAIDQE TGNITLMEKC DVTDLGLHRV LVKANDLGQP
 781 DSLFSVVIVN LFVNESVTNA TLINELVRKS IEAPVTPNTE IADVSSPTSD YVKILVAAVA
 841 GTITVVVVIF ITAVVRCRQA PHLKAAQKNM QNSEWATPNP ENRQMIMMKK KKKKKKHSPK
 901 NLLLNVVTIE ETKADDVDSD GNRVTLDLPI DLEEQTMGKY NWVTTPTTFK PDSPDLARHY
 961 KSASPQPAFQ IQPETPLNLK HHIIQELPLD NTFVACDSIS NCSSSSSDPY SVSDCGYPVT
1021 TFEVPVSVHT RPTDSRT
```

Figure 4: Alignment of 109P1D4 v.1 Protein (SEQ ID NO: 29) with protocadherin-11 (SEQ ID NO: 30)

```
        protocadherin 11 X-linked isoform a precursor; protocadherin X;
            protocadherin-S [Homo sapiens]
  dbj|BAA90765.1| protocadherin-Xa [Homo sapiens]
        Length = 1021

Score = 2024 bits (5244), Expect = 0.0
 Identities = 1021/1021 (100%), Positives = 1021/1021 (100%)

Query:   1   MDLLSGTYIFAVLLACVVFHSGAQEKNYTIREEMPENVLIGDLLKDLNLSLIPNKSLTTA  60
             MDLLSGTYIFAVLLACVVFHSGAQEKNYTIREEMPENVLIGDLLKDLNLSLIPNKSLTTA
Sbjct:   1   MDLLSGTYIFAVLLACVVFHSGAQEKNYTIREEMPENVLIGDLLKDLNLSLIPNKSLTTA  60

Query:  61   MQFKLVYKTGDVPLIRIEEDTGEIFTTGARIDREKLCAGIPRDEHCFYEVEVAILPDEIF  120
             MQFKLVYKTGDVPLIRIEEDTGEIFTTGARIDREKLCAGIPRDEHCFYEVEVAILPDEIF
Sbjct:  61   MQFKLVYKTGDVPLIRIEEDTGEIFTTGARIDREKLCAGIPRDEHCFYEVEVAILPDEIF  120

Query: 121   RLVKIRFLIEDINDNAPLFPATVINISIPENSAINSKYTLPAAVDPDVGINGVQNYELIK  180
             RLVKIRFLIEDINDNAPLFPATVINISIPENSAINSKYTLPAAVDPDVGINGVQNYELIK
Sbjct: 121   RLVKIRFLIEDINDNAPLFPATVINISIPENSAINSKYTLPAAVDPDVGINGVQNYELIK  180

Query: 181   SQNIFGLDVIETPEGDKMPQLIVQKELDREEKDTYVMKVKVEDGGFPQRSSTAILQVSVT  240
             SQNIFGLDVIETPEGDKMPQLIVQKELDREEKDTYVMKVKVEDGGFPQRSSTAILQVSVT
Sbjct: 181   SQNIFGLDVIETPEGDKMPQLIVQKELDREEKDTYVMKVKVEDGGFPQRSSTAILQVSVT  240

Query: 241   DTNDNHPVFKETEIEVSIPENAPVGTSVTQLHATDADIGENAKIHFSFSNLVSNIARRLF  300
             DTNDNHPVFKETEIEVSIPENAPVGTSVTQLHATDADIGENAKIHFSFSNLVSNIARRLF
Sbjct: 241   DTNDNHPVFKETEIEVSIPENAPVGTSVTQLHATDADIGENAKIHFSFSNLVSNIARRLF  300

Query: 301   HLNATTGLITIKEPLDREETPNHKLLVLASDGGLMPARAMVLVNVTDVNDNVPSIDIRYI  360
             HLNATTGLITIKEPLDREETPNHKLLVLASDGGLMPARAMVLVNVTDVNDNVPSIDIRYI
Sbjct: 301   HLNATTGLITIKEPLDREETPNHKLLVLASDGGLMPARAMVLVNVTDVNDNVPSIDIRYI  360

Query: 361   VNPVNDTVVLSENIPLNTKIALITVTDKDADHNGRVTCFTDHEIPFRLRPVFSNQFLLET  420
             VNPVNDTVVLSENIPLNTKIALITVTDKDADHNGRVTCFTDHEIPFRLRPVFSNQFLLET
Sbjct: 361   VNPVNDTVVLSENIPLNTKIALITVTDKDADHNGRVTCFTDHEIPFRLRPVFSNQFLLET  420

Query: 421   AAYLDYESTKEYAIKLLAADAGKPPLNQSAMLFIKVKDENDNAPVFTQSFVTVSIPENNS  480
             AAYLDYESTKEYAIKLLAADAGKPPLNQSAMLFIKVKDENDNAPVFTQSFVTVSIPENNS
Sbjct: 421   AAYLDYESTKEYAIKLLAADAGKPPLNQSAMLFIKVKDENDNAPVFTQSFVTVSIPENNS  480

Query: 481   PGIQLTKVSAMDADSGPNAKINYLLGPDAPPEFSLDCRTGMLTVVKKLDREKEDKYLFTI  540
             PGIQLTKVSAMDADSGPNAKINYLLGPDAPPEFSLDCRTGMLTVVKKLDREKEDKYLFTI
Sbjct: 481   PGIQLTKVSAMDADSGPNAKINYLLGPDAPPEFSLDCRTGMLTVVKKLDREKEDKYLFTI  540

Query: 541   LAKDNGVPPLTSNVTVFVSIIDQNDNSPVFTHNEYNFYVPENLPRHGTVGLITVTDPDYG  600
             LAKDNGVPPLTSNVTVFVSIIDQNDNSPVFTHNEYNFYVPENLPRHGTVGLITVTDPDYG
Sbjct: 541   LAKDNGVPPLTSNVTVFVSIIDQNDNSPVFTHNEYNFYVPENLPRHGTVGLITVTDPDYG  600

Query: 601   DNSAVTLSILDENDDFTIDSQTGVIRPNISFDREKQESYTFYVKAEDGGRVSRSSSAKVT  660
             DNSAVTLSILDENDDFTIDSQTGVIRPNISFDREKQESYTFYVKAEDGGRVSRSSSAKVT
Sbjct: 601   DNSAVTLSILDENDDFTIDSQTGVIRPNISFDREKQESYTFYVKAEDGGRVSRSSSAKVT  660

Query: 661   INVVDVNDNKPVFIVPPSNCSYELVLPSTNPGTVVFQVIAVDNDTGMNAEVRYSIVGGNT  720
             INVVDVNDNKPVFIVPPSNCSYELVLPSTNPGTVVFQVIAVDNDTGMNAEVRYSIVGGNT
Sbjct: 661   INVVDVNDNKPVFIVPPSNCSYELVLPSTNPGTVVFQVIAVDNDTGMNAEVRYSIVGGNT  720

Query: 721   RDLFAIDQETGNITLMEKCDVTDLGLHRVLVKANDLGQPDSLFSVVIVNLFVNESVTNAT  780
             RDLFAIDQETGNITLMEKCDVTDLGLHRVLVKANDLGQPDSLFSVVIVNLFVNESVTNAT
Sbjct: 721   RDLFAIDQETGNITLMEKCDVTDLGLHRVLVKANDLGQPDSLFSVVIVNLFVNESVTNAT  780

Query: 781   LINELVRKSTEAPVTPNTEIADVSSPTSDYVKILVAAVAGTITVVVVIFITAVVRCRQAP  840
             LINELVRKSTEAPVTPNTEIADVSSPTSDYVKILVAAVAGTITVVVVIFITAVVRCRQAP
Sbjct: 781   LINELVRKSTEAPVTPNTEIADVSSPTSDYVKILVAAVAGTITVVVVIFITAVVRCRQAP  840

Query: 841   HLKAAQKNKQNSEWATPNPENRQMIMMKKKKKKKKKHSPKNLLLNFVTIEETKADDVDSDG  900
             HLKAAQKNKQNSEWATPNPENRQMIMMKKKKKKKKKHSPKNLLLNFVTIEETKADDVDSDG
Sbjct: 841   HLKAAQKNKQNSEWATPNPENRQMIMMKKKKKKKKKHSPKNLLLNFVTIEETKADDVDSDG  900
```

Figure 4-2

```
Query: 901   NRVTLDLPIDLEEQTMGKYNWVTTPTTFKPDSPDLARHYKSASPQPAFQIQPETPLNSKH 960
             NRVTLDLPIDLEEQTMGKYNWVTTPTTFKPDSPDLARHYKSASPQPAFQIQPETPLNSKH
Sbjct: 901   NRVTLDLPIDLEEQTMGKYNWVTTPTTFKPDSPDLARHYKSASPQPAFQIQPETPLNSKH 960

Query: 961   HIIQELPLDNTFVACDSISKCSSSSSDPYSVSDCGYPVTTFEVPVSVHTRPVGIQVSNTT 1020
             HIIQELPLDNTFVACDSISKCSSSSSDPYSVSDCGYPVTTFEVPVSVHTRPVGIQVSNTT
Sbjct: 961   HIIQELPLDNTFVACDSISKCSSSSSDPYSVSDCGYPVTTFEVPVSVHTRPVGIQVSNTT 1020

Query: 1021  F 1021
             F
Sbjct: 1021  F 1021
```

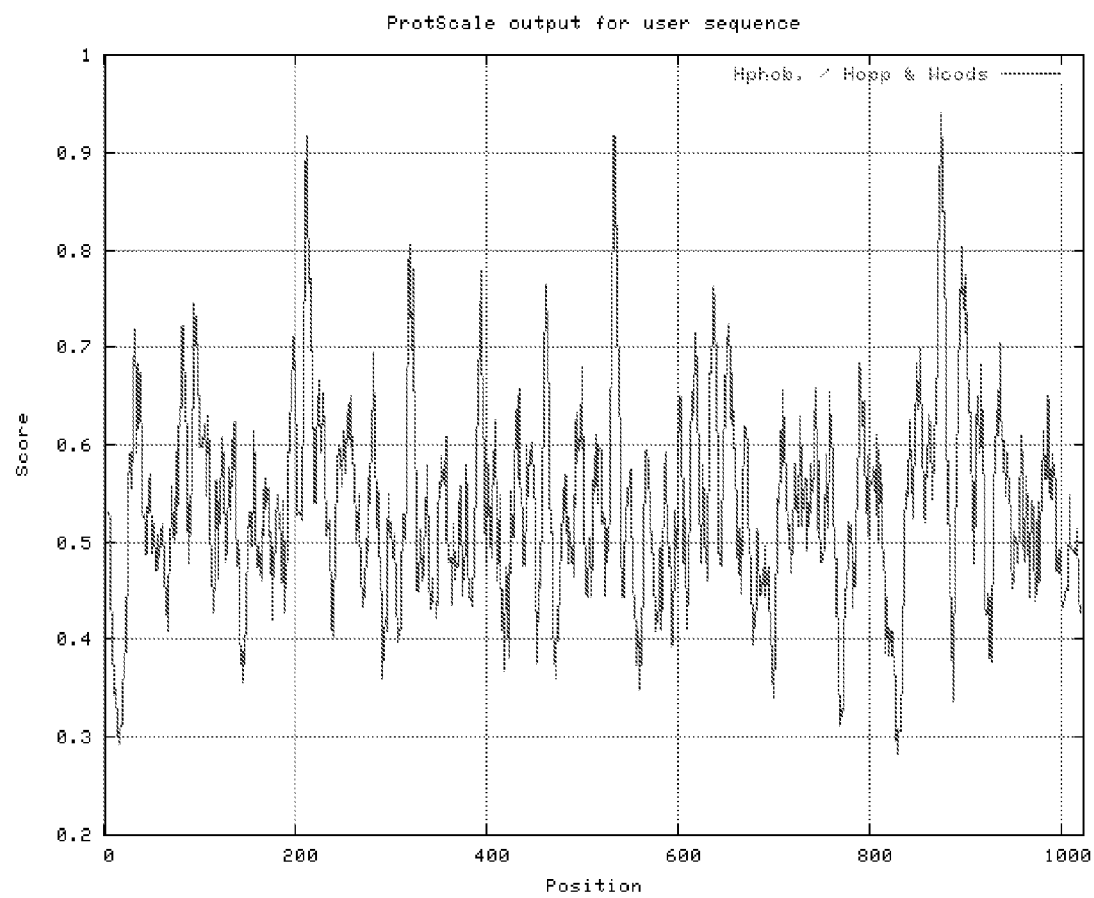
Figure 5a: 109P1D4 variant 1
Hydrophilicity profile
(Hopp T.P., Woods K.R., 1981.
Proc. Natl. Acad. Sci. U.S.A. 78:3824-3828)

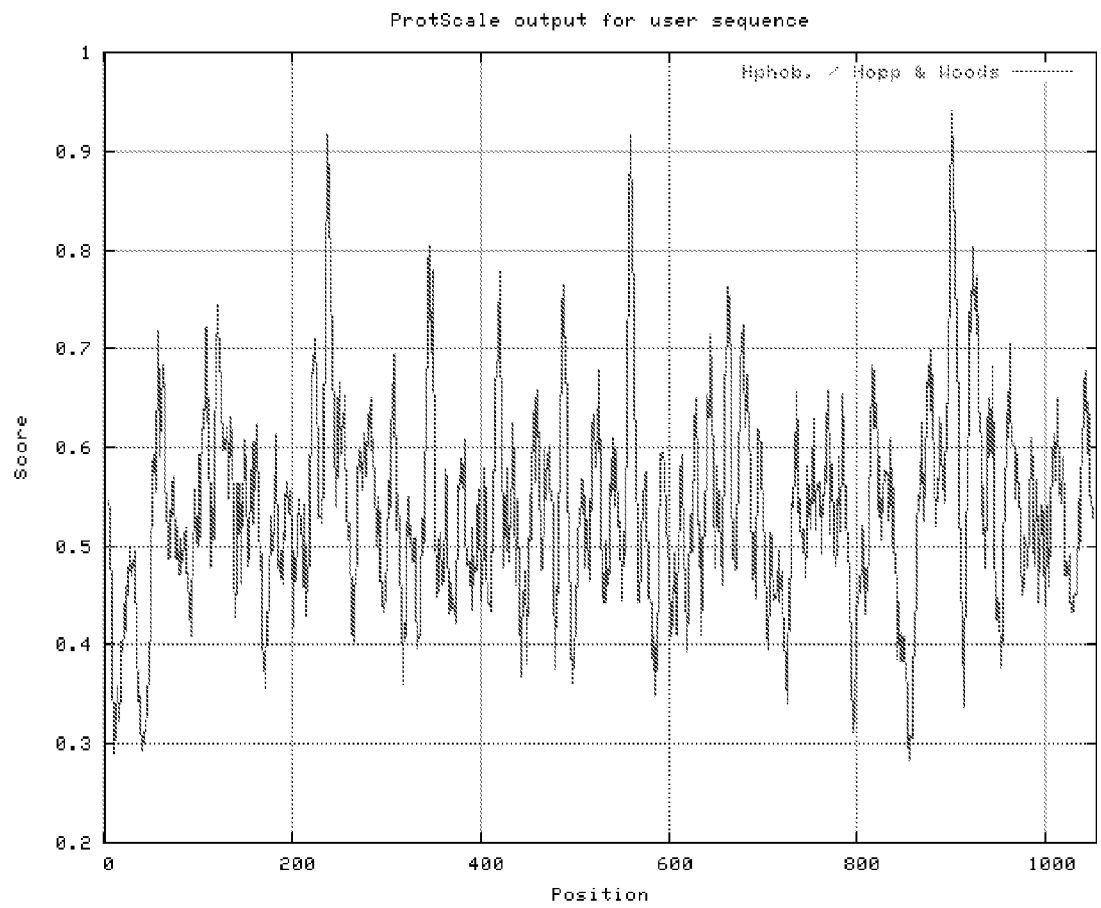
Figure 5b: 109P1D4 variant 2
Hydrophilicity profile
(Hopp T.P., Woods K.R., 1981.
Proc. Natl. Acad. Sci. U.S.A. 78:3824-3828)

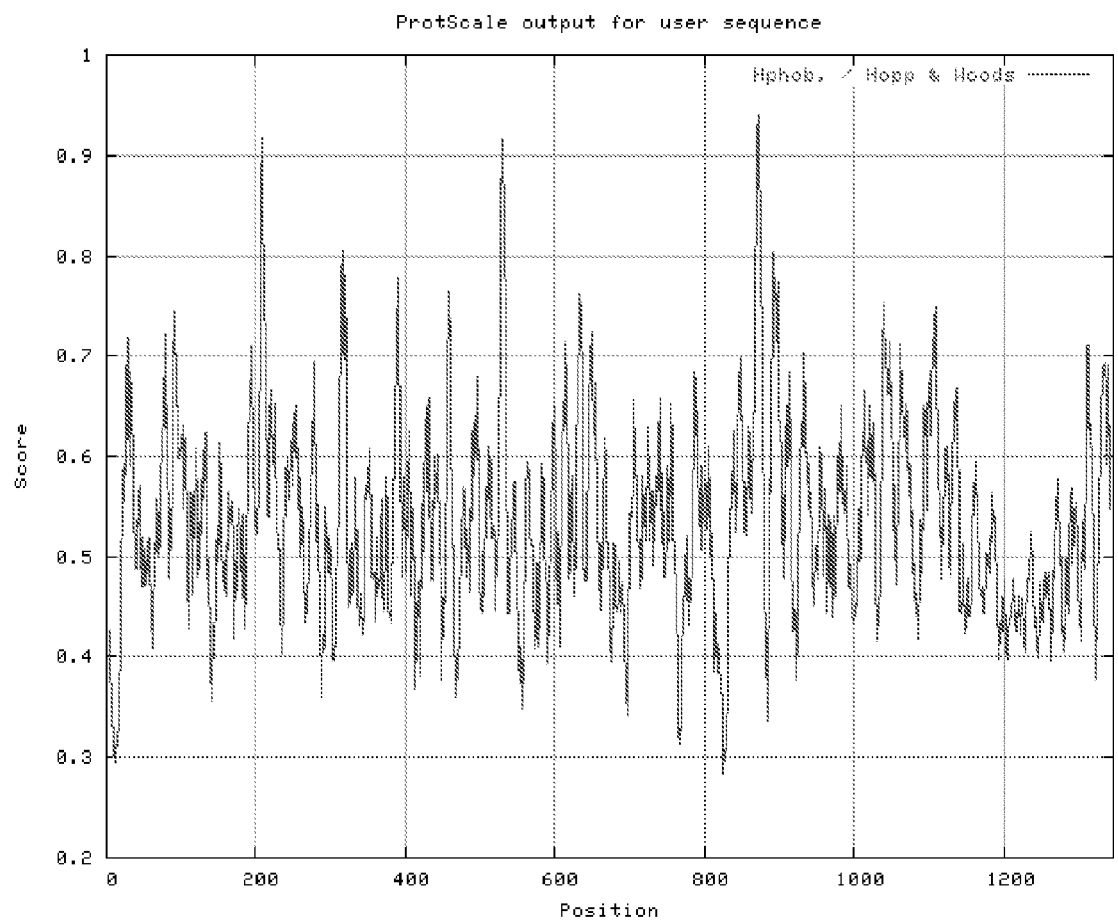
Figure 5c: 109P1D4 variant 3
Hydrophilicity profile
(Hopp T.P., Woods K.R., 1981.
Proc. Natl. Acad. Sci. U.S.A. 78:3824-3828)

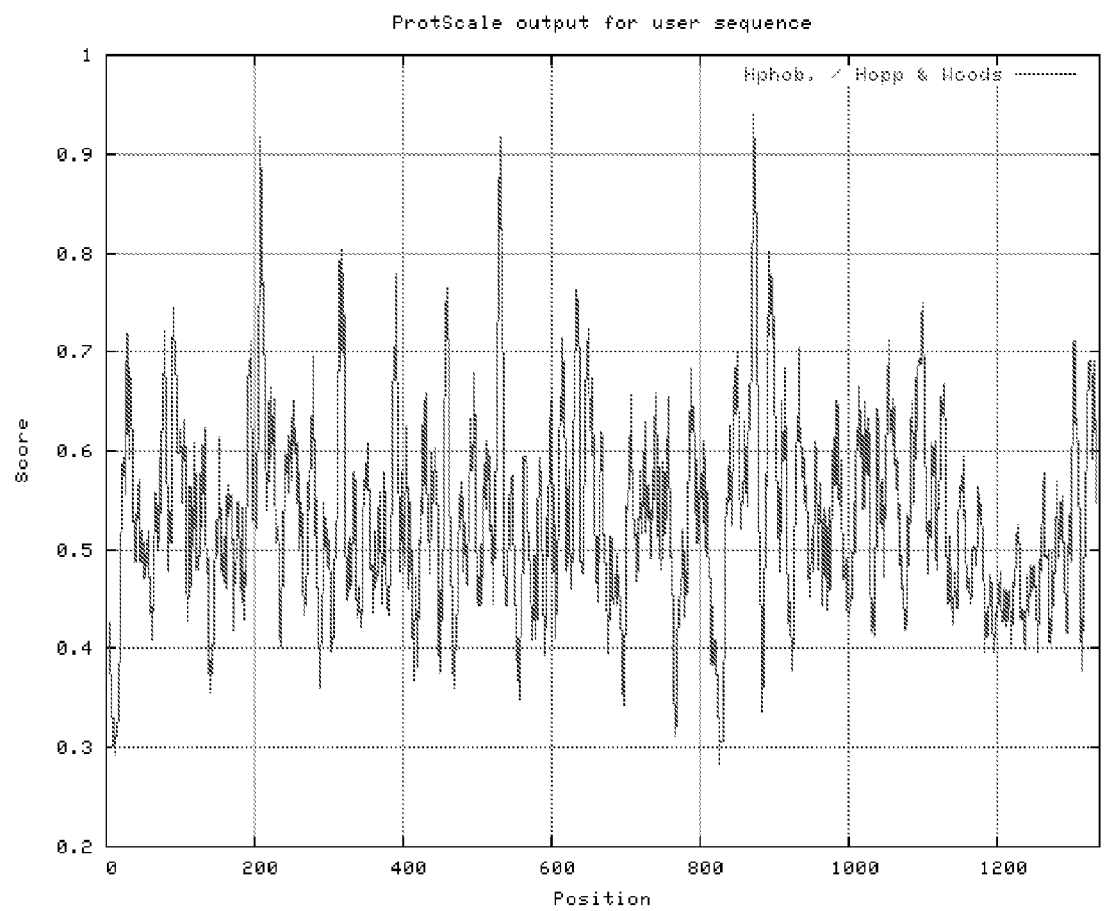
Figure 5d: 109P1D4 variant 4
Hydrophilicity profile
(Hopp T.P., Woods K.R., 1981.
Proc. Natl. Acad. Sci. U.S.A. 78:3824-3828)

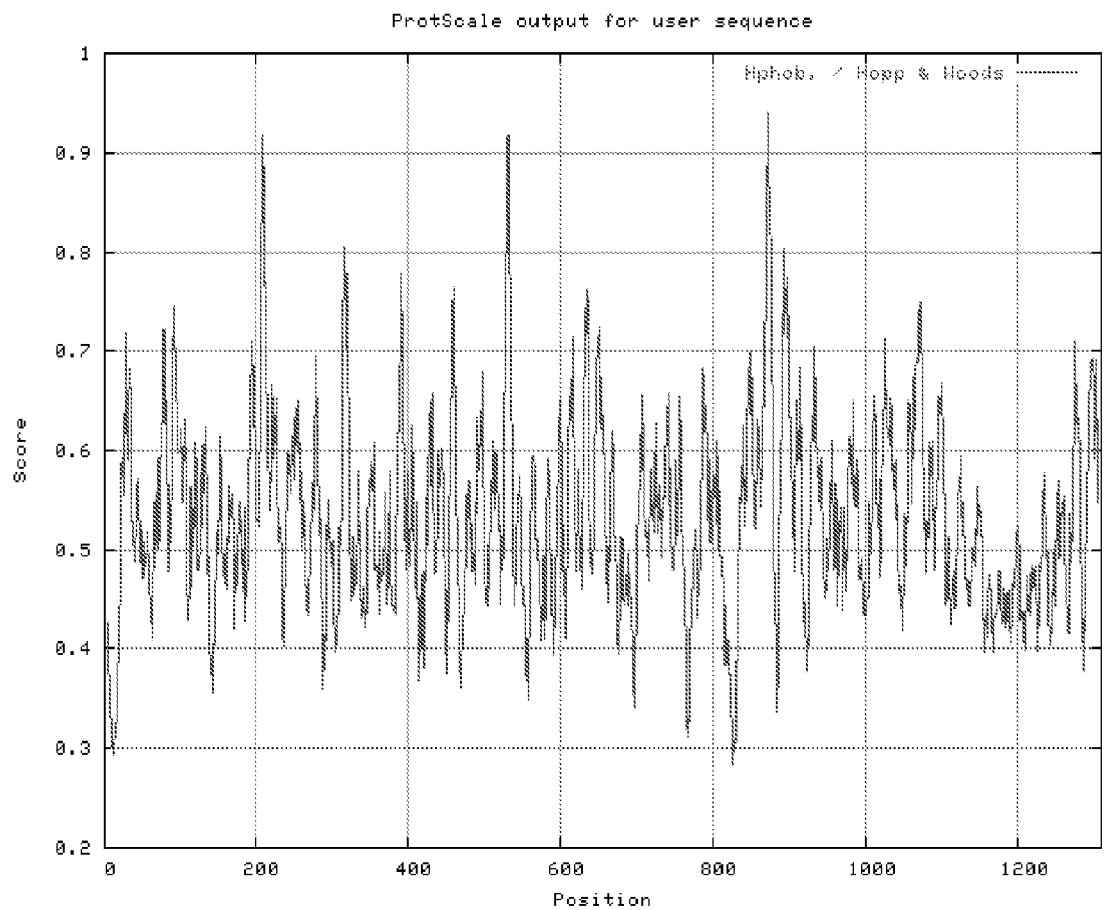
Figure 5e: 109P1D4 variant 5 Hydrophilicity profile
(Hopp T.P., Woods K.R., 1981.
Proc. Natl. Acad. Sci. U.S.A. 78:3824-3828)

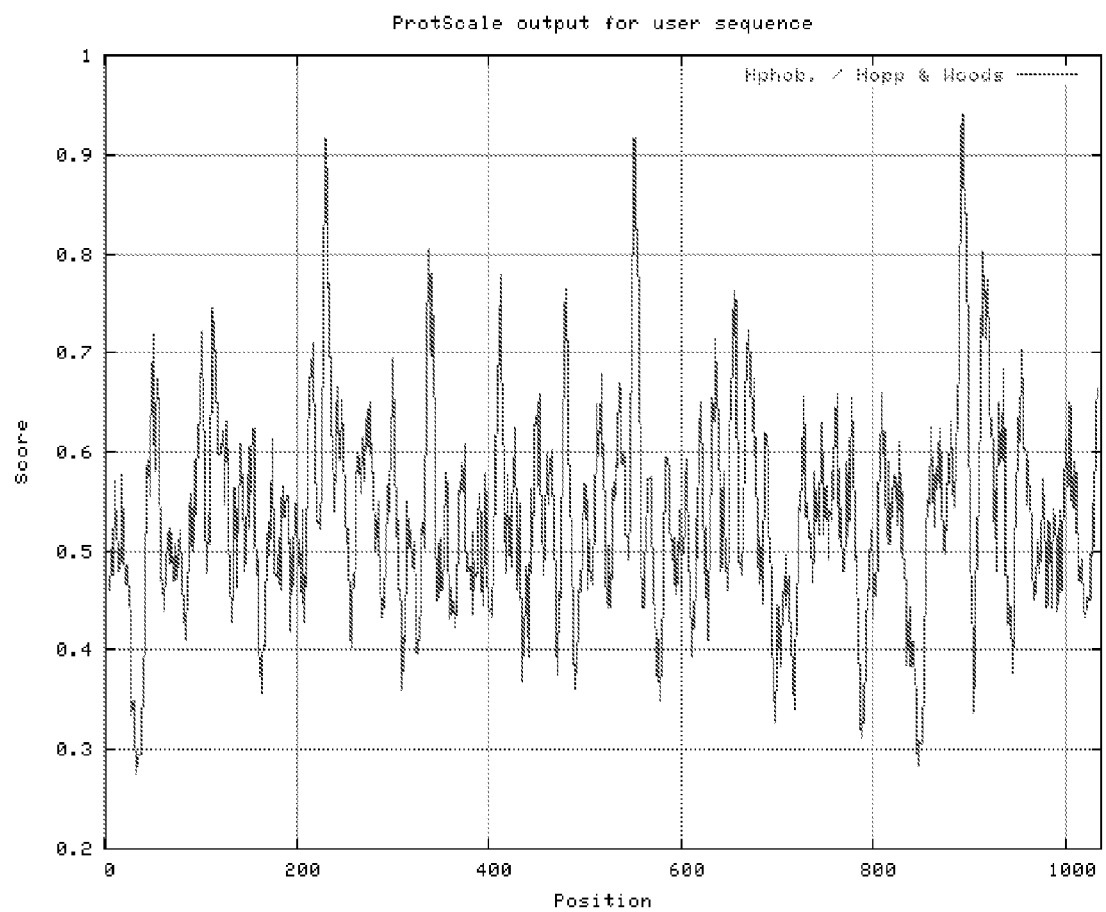
Figure 5f: 109P1D4 variant 6
Hydrophilicity profile
(Hopp T.P., Woods K.R., 1981.
Proc. Natl. Acad. Sci. U.S.A. 78:3824-3828)

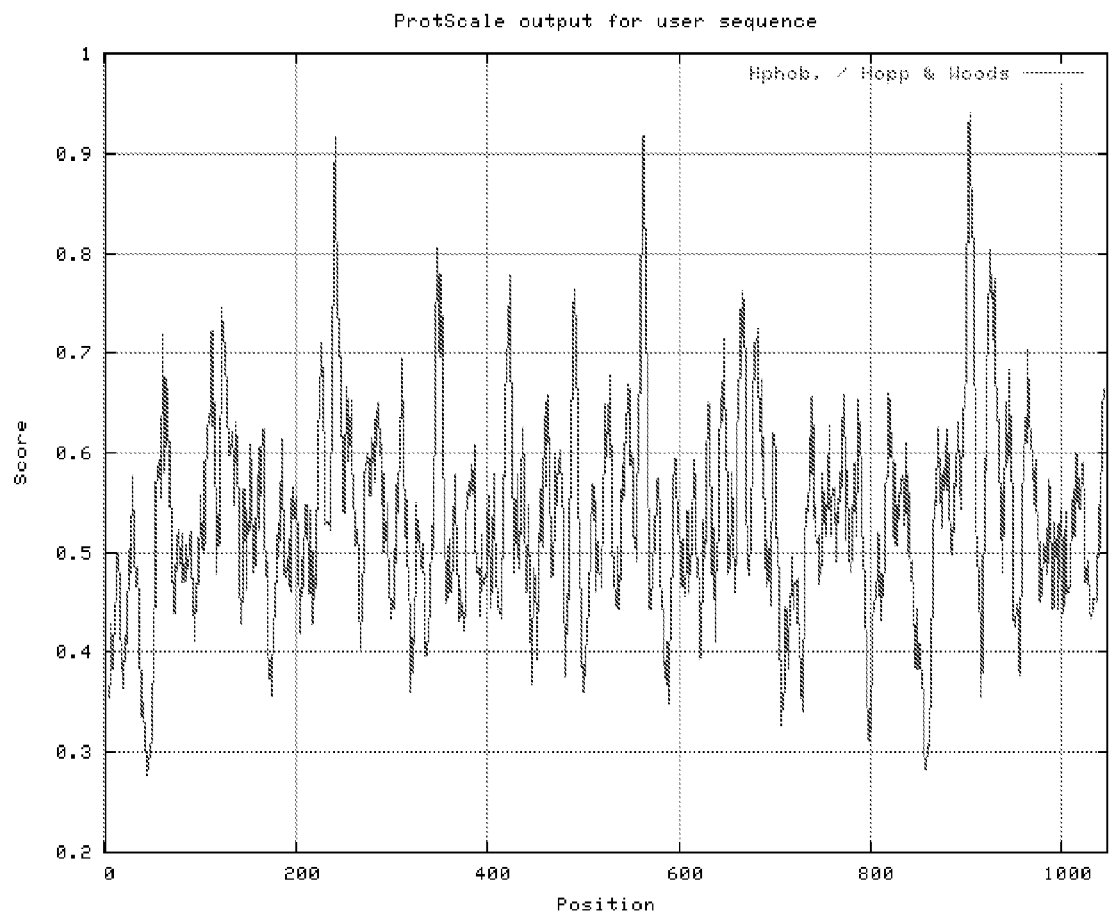
Figure 5g: 109P1D4 variant 7
Hydrophilicity profile
(Hopp T.P., Woods K.R., 1981.
Proc. Natl. Acad. Sci. U.S.A. 78:3824-3828)

Figure 5h: 109P1D4 variant 8
Hydrophilicity profile
(Hopp T.P., Woods K.R., 1981.
Proc. Natl. Acad. Sci. U.S.A. 78:3824-3828)
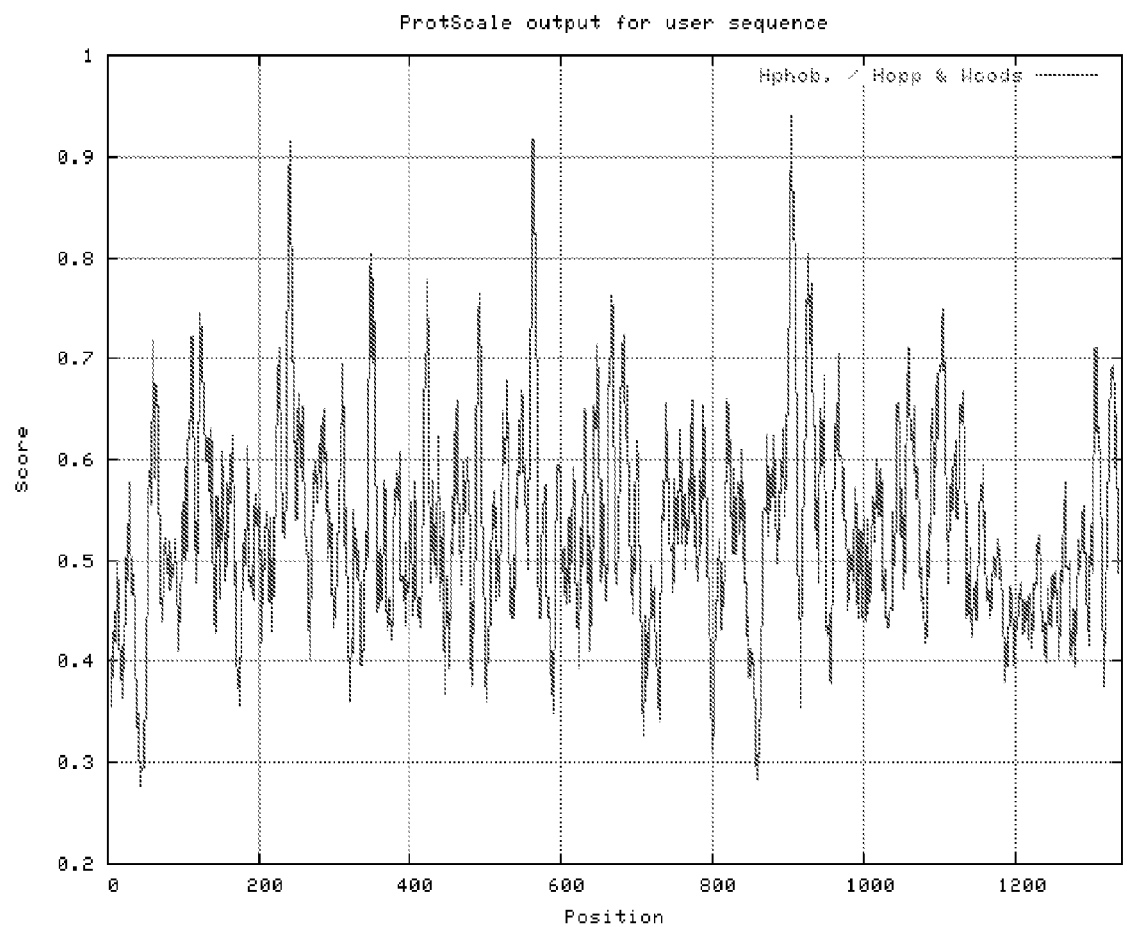

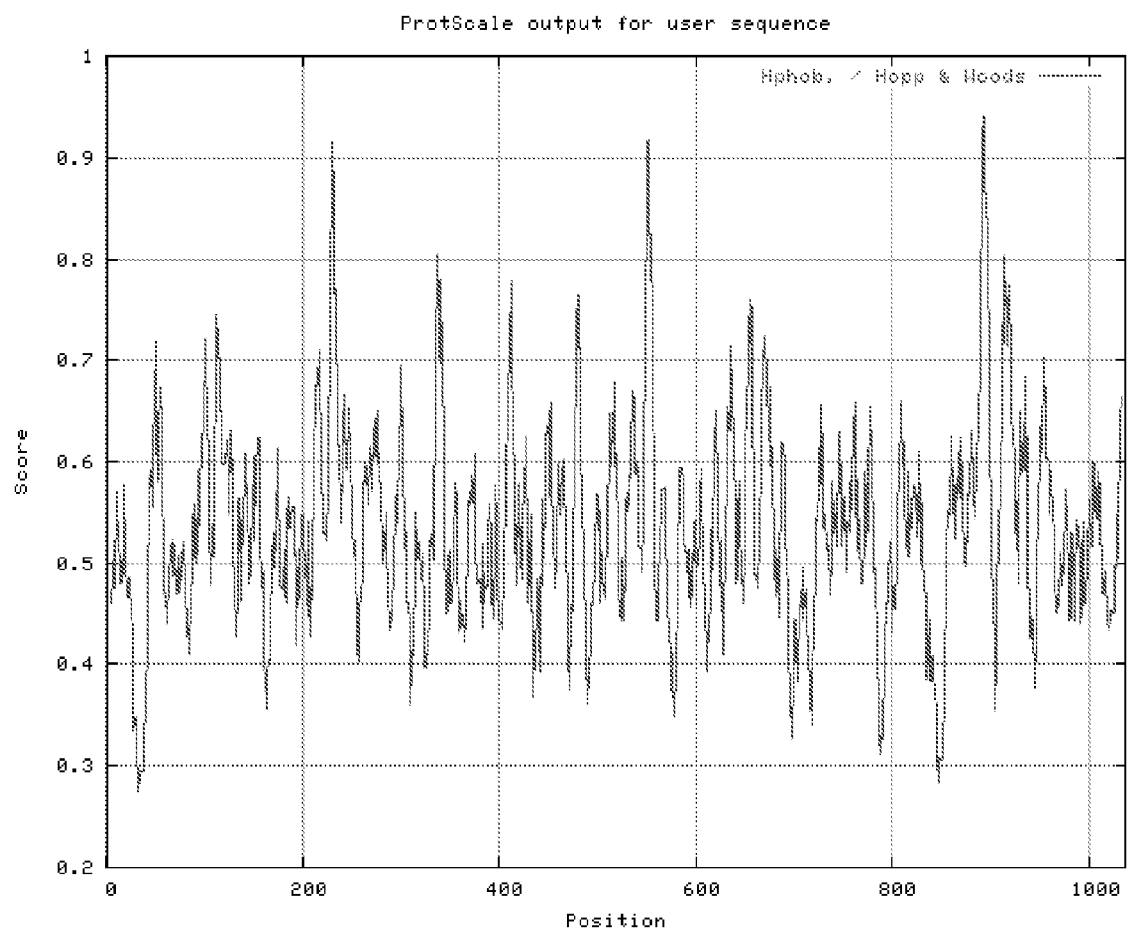
Figure 5i: 109P1D4 variant 9
Hydrophilicity profile
(Hopp T.P., Woods K.R., 1981.
Proc. Natl. Acad. Sci. U.S.A. 78:3824-3828)

Figure 6a: 109P1D4 variant 1
Hydropathicity Profile
(Kyte J., Doolittle R.F., 1982. J. Mol. Biol. 157:105-132)
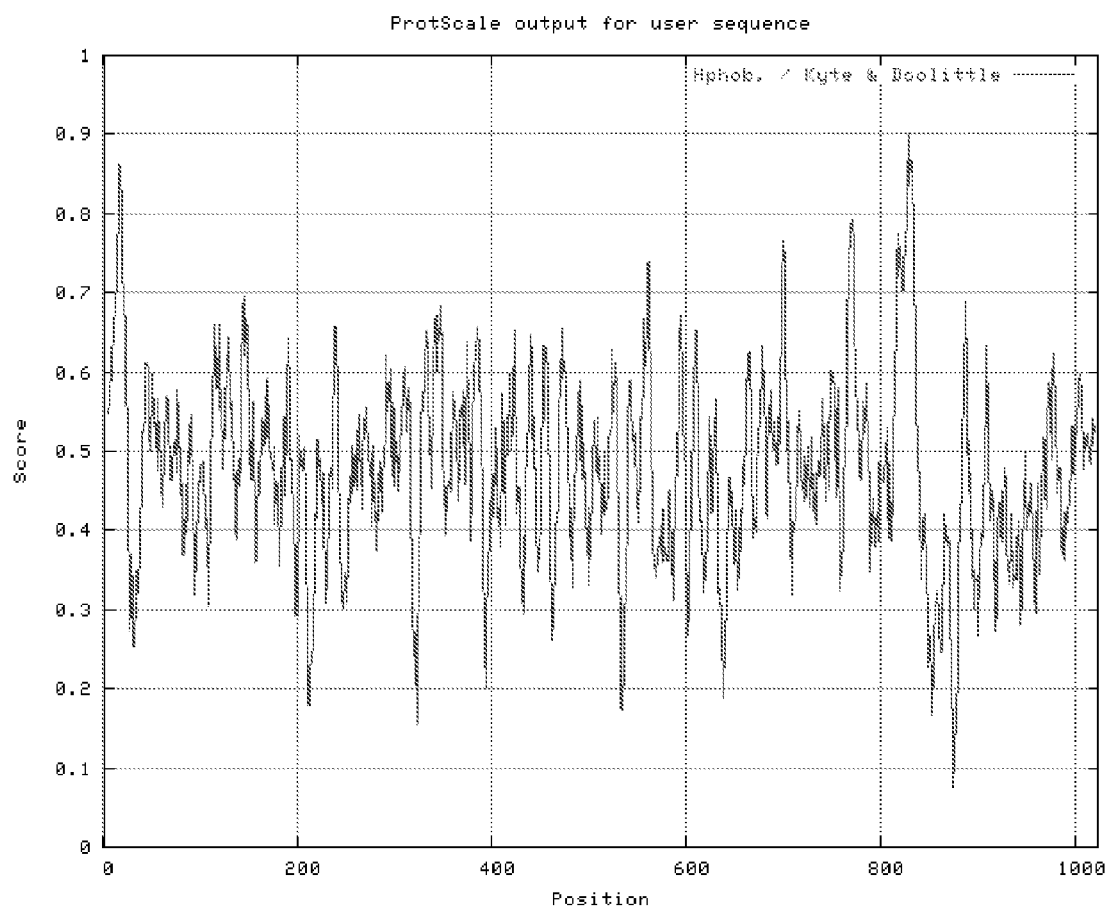

Figure 6b: 109P1D4 variant 2
Hydropathicity Profile
(Kyte J., Doolittle R.F., 1982. J. Mol. Biol. 157:105-132)
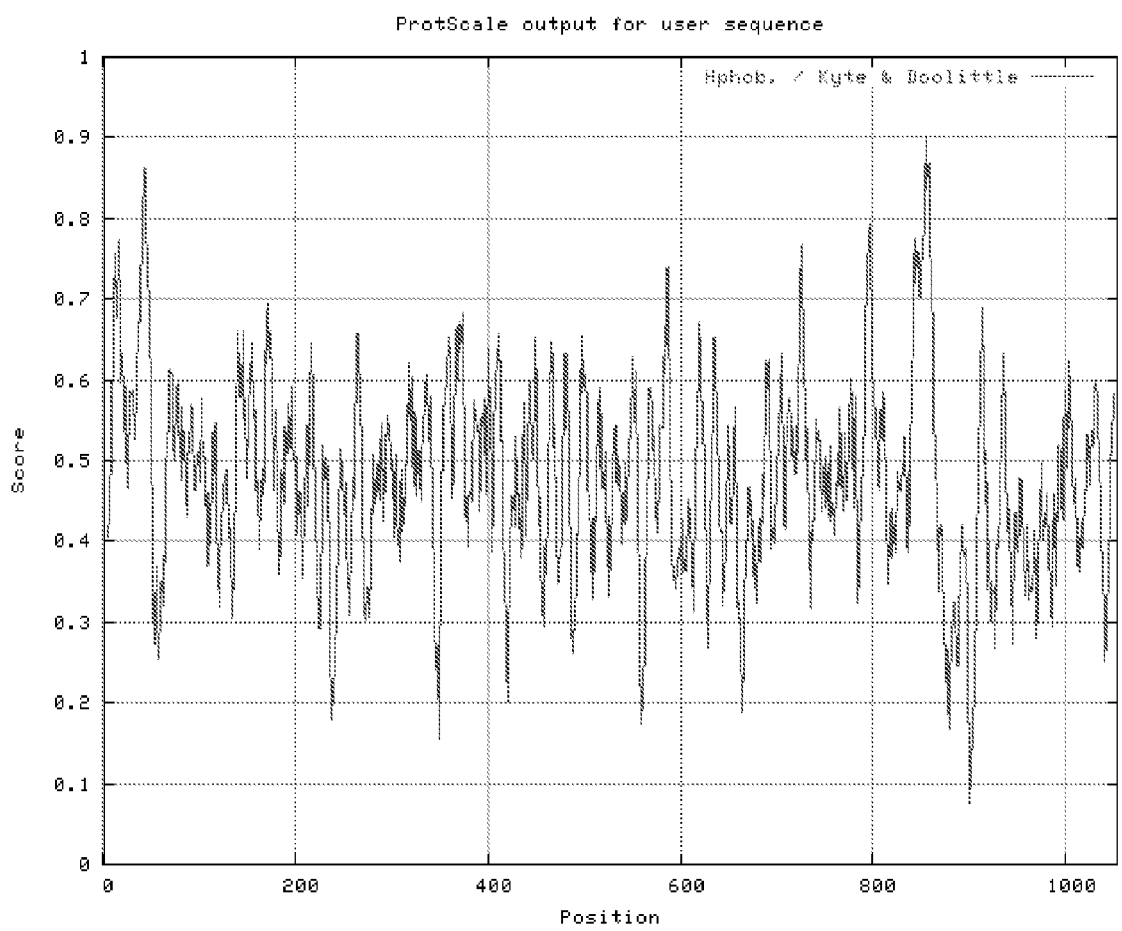

Figure 6c: 109P1D4 variant 3
Hydropathicity Profile
(Kyte J., Doolittle R.F., 1982. J. Mol. Biol. 157:105-132)
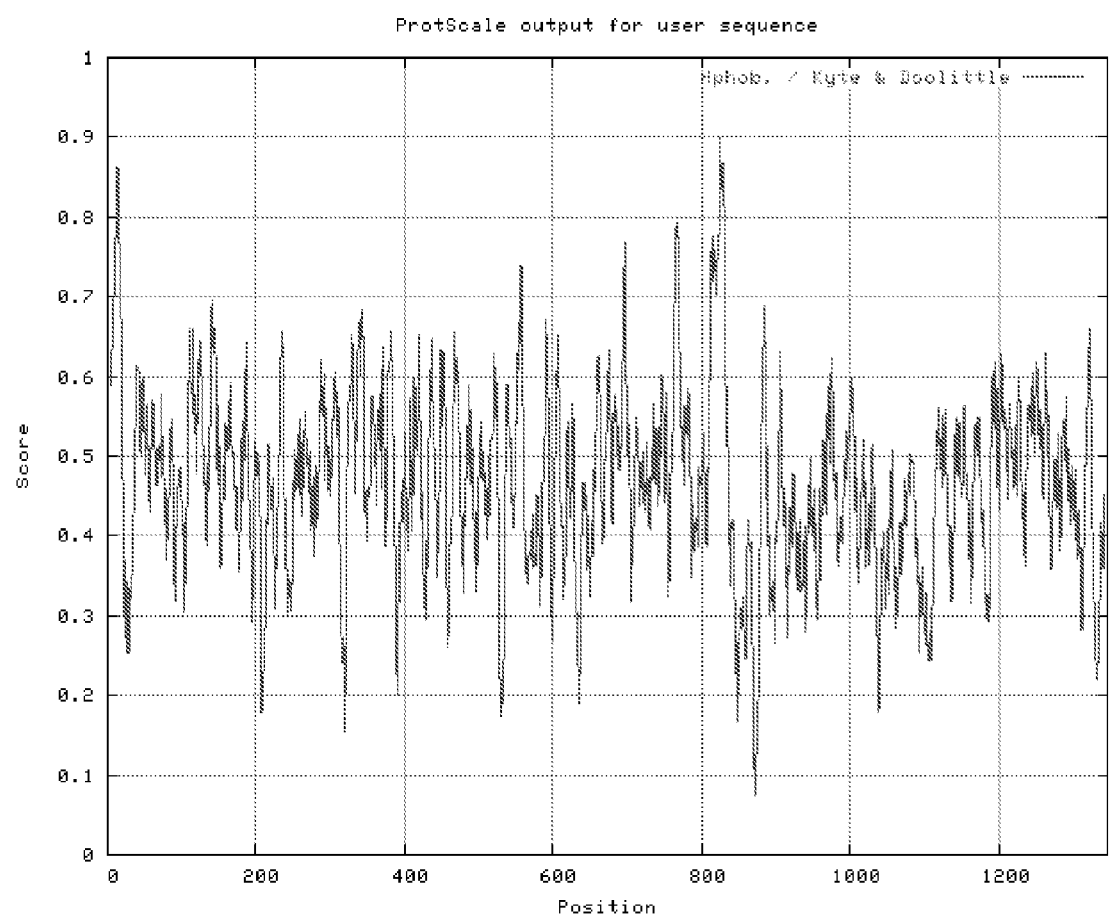

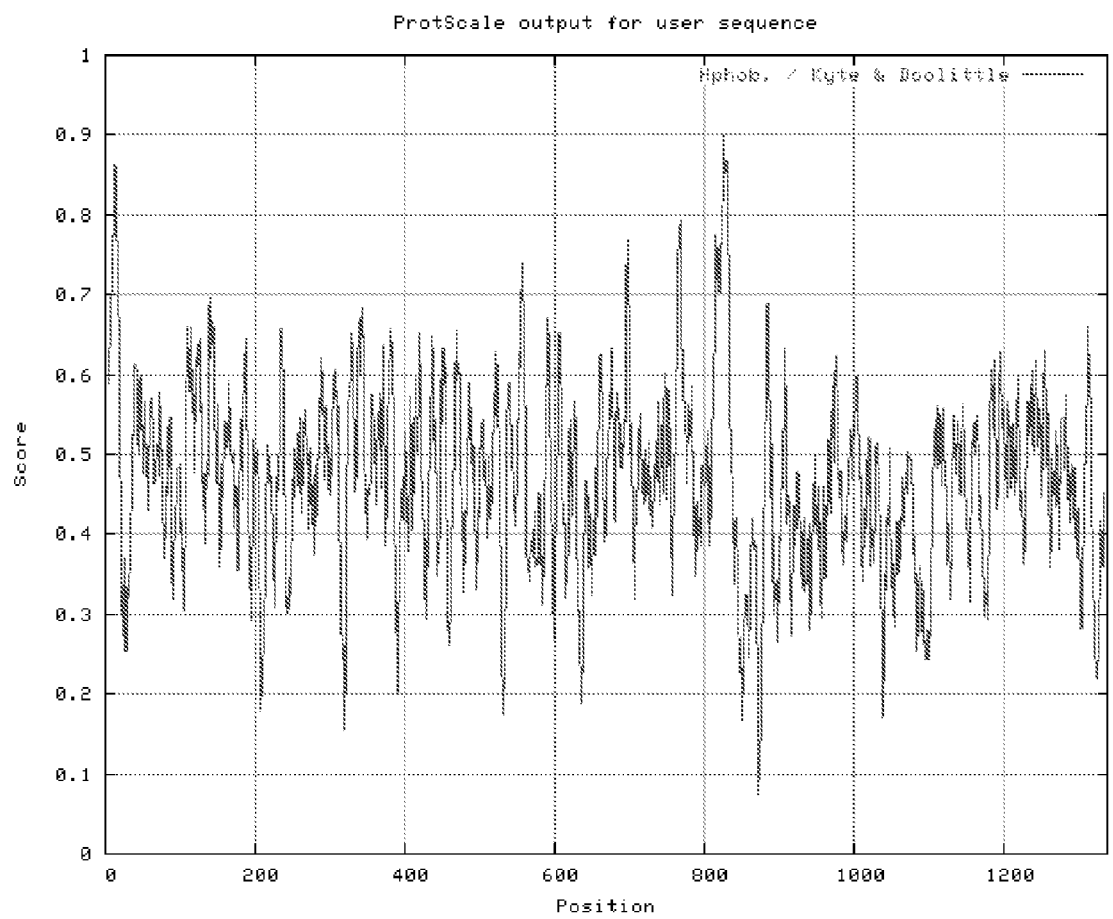
Figure 6d: 109P1D4 variant 4
Hydropathicity Profile
(Kyte J., Doolittle R.F., 1982. J. Mol. Biol. 157:105-132)

Figure 6e: 109P1D4 variant 5
Hydropathicity Profile
(Kyte J., Doolittle R.F., 1982. J. Mol. Biol. 157:105-132)
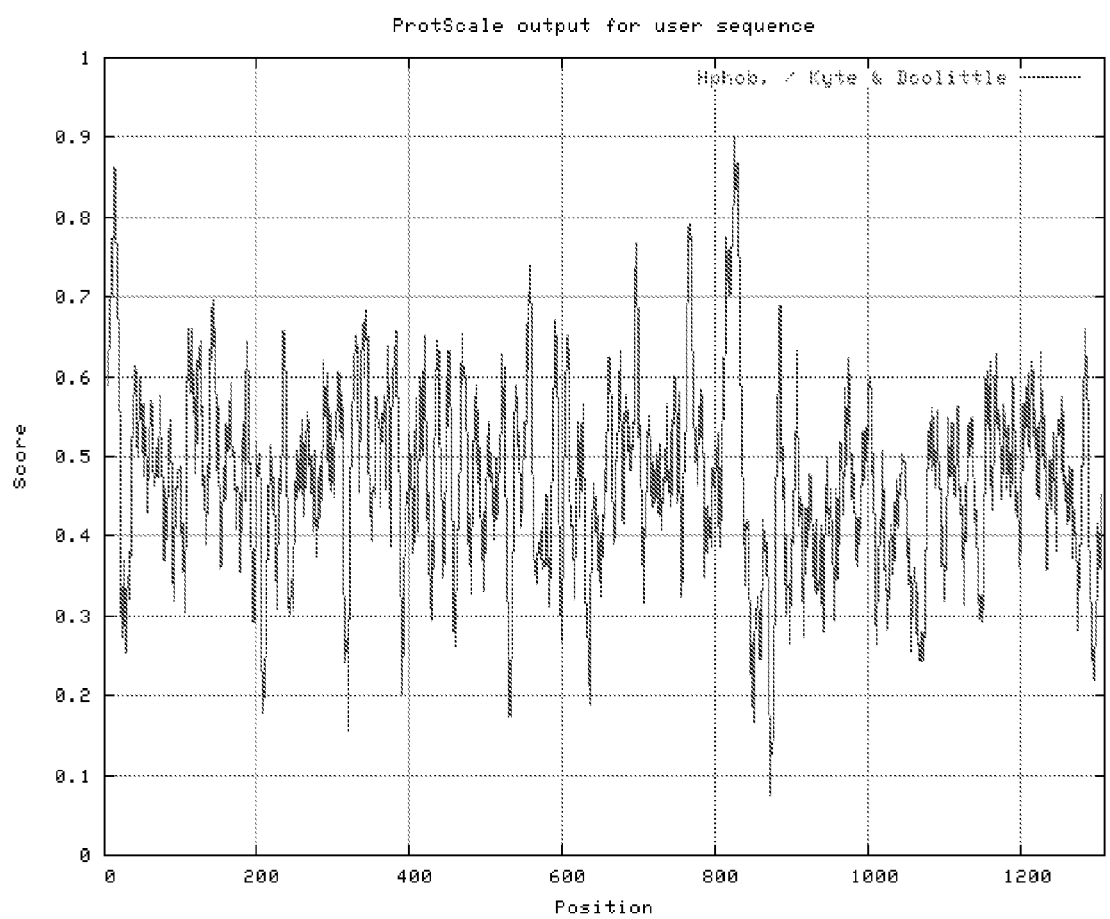

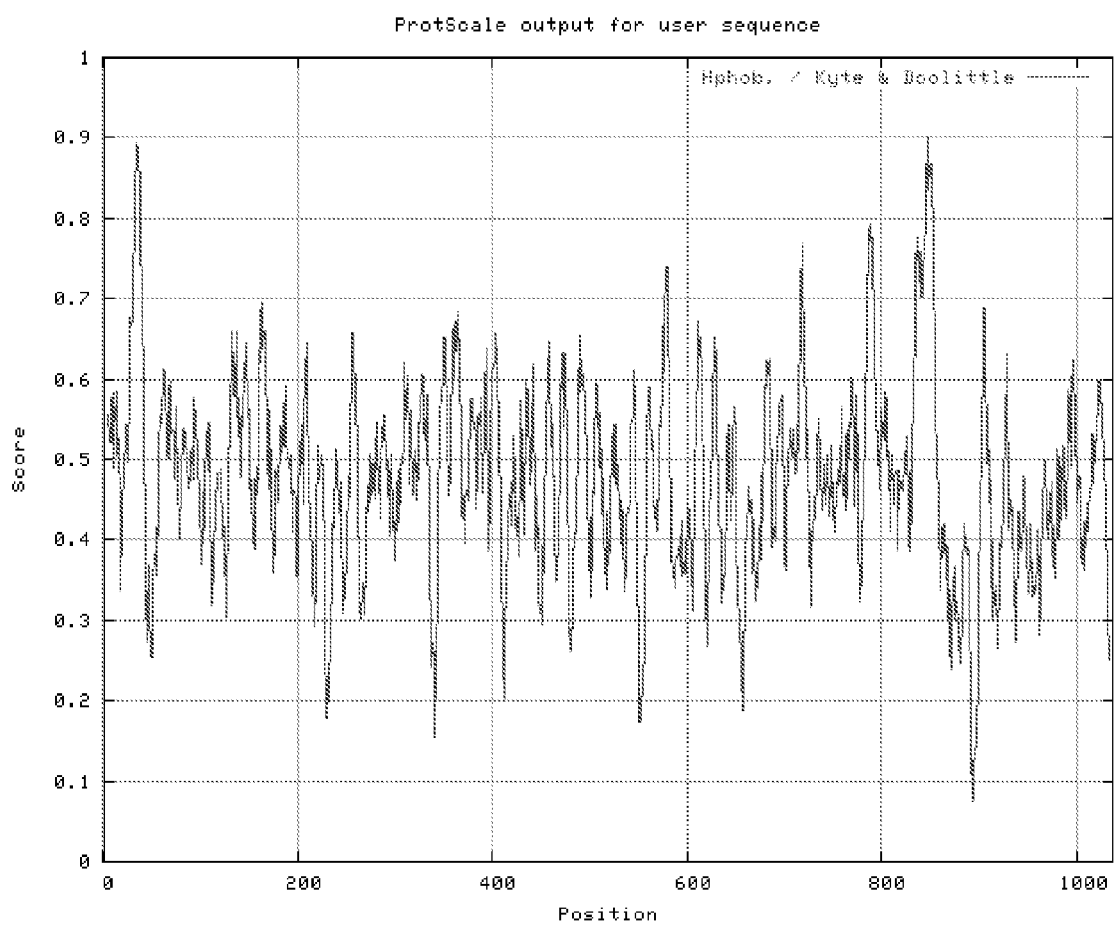
Figure 6f: 109P1D4 variant 6
Hydropathicity Profile
(Kyte J., Doolittle R.F., 1982. J. Mol. Biol. 157:105-132)

Figure 6g: 109P1D4 variant 7
Hydropathicity Profile
(Kyte J., Doolittle R.F., 1982. J. Mol. Biol. 157:105-132)
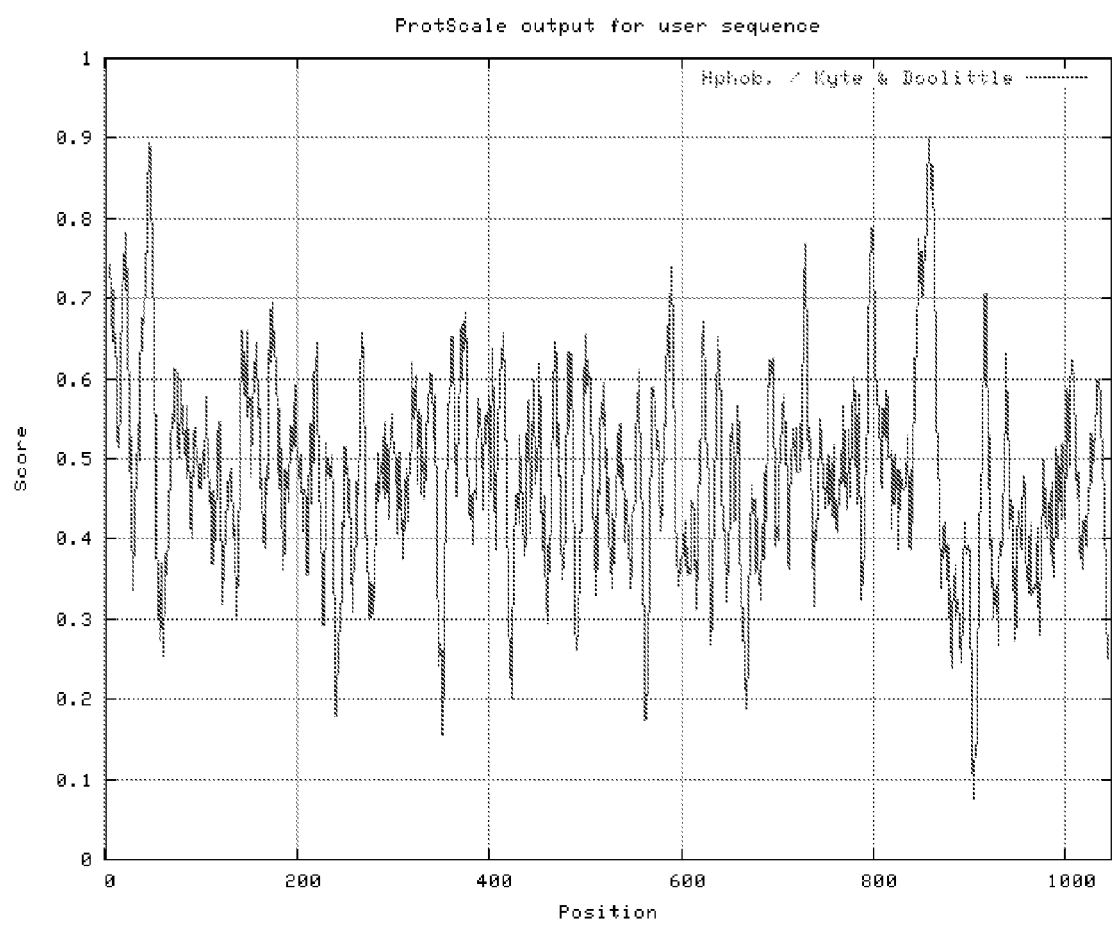

Figure 6h: 109P1D4 variant 8
Hydropathicity Profile
(Kyte J., Doolittle R.F., 1982. J. Mol. Biol. 157:105-132)
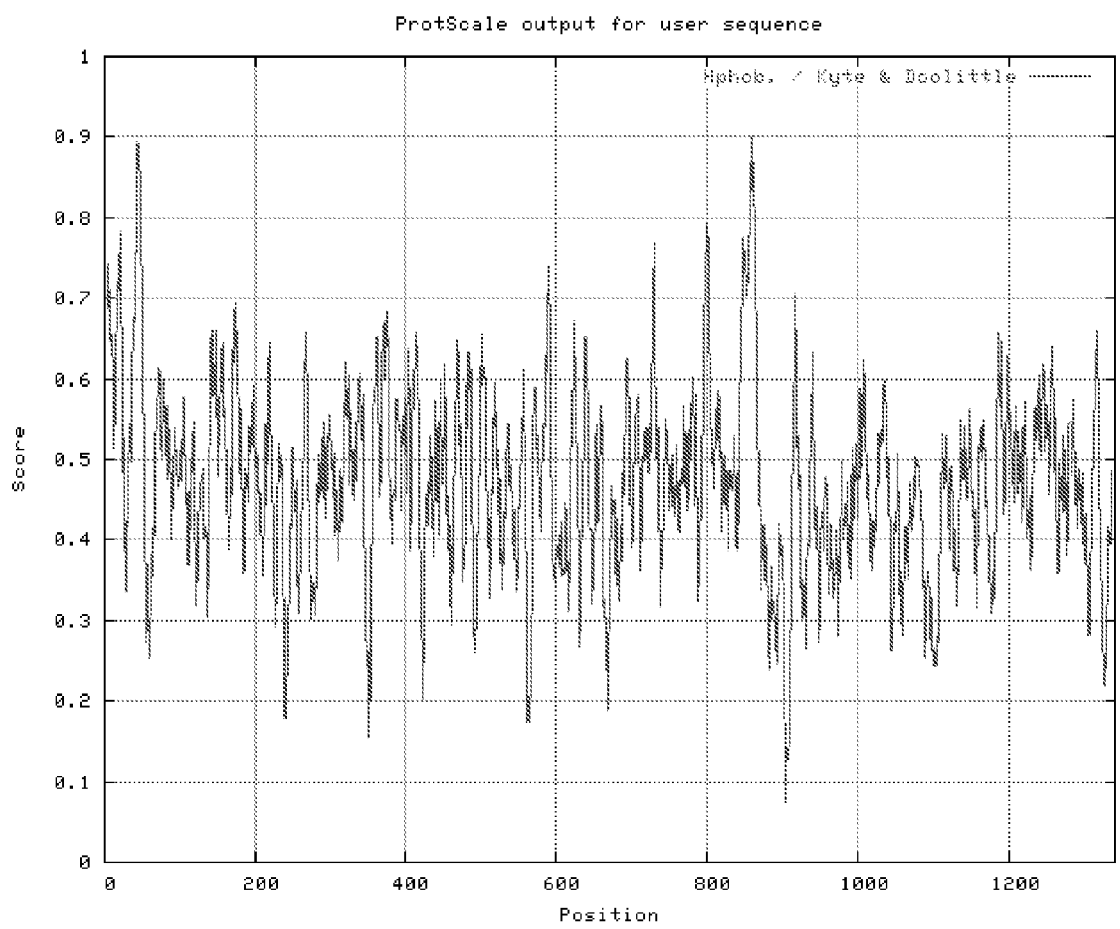

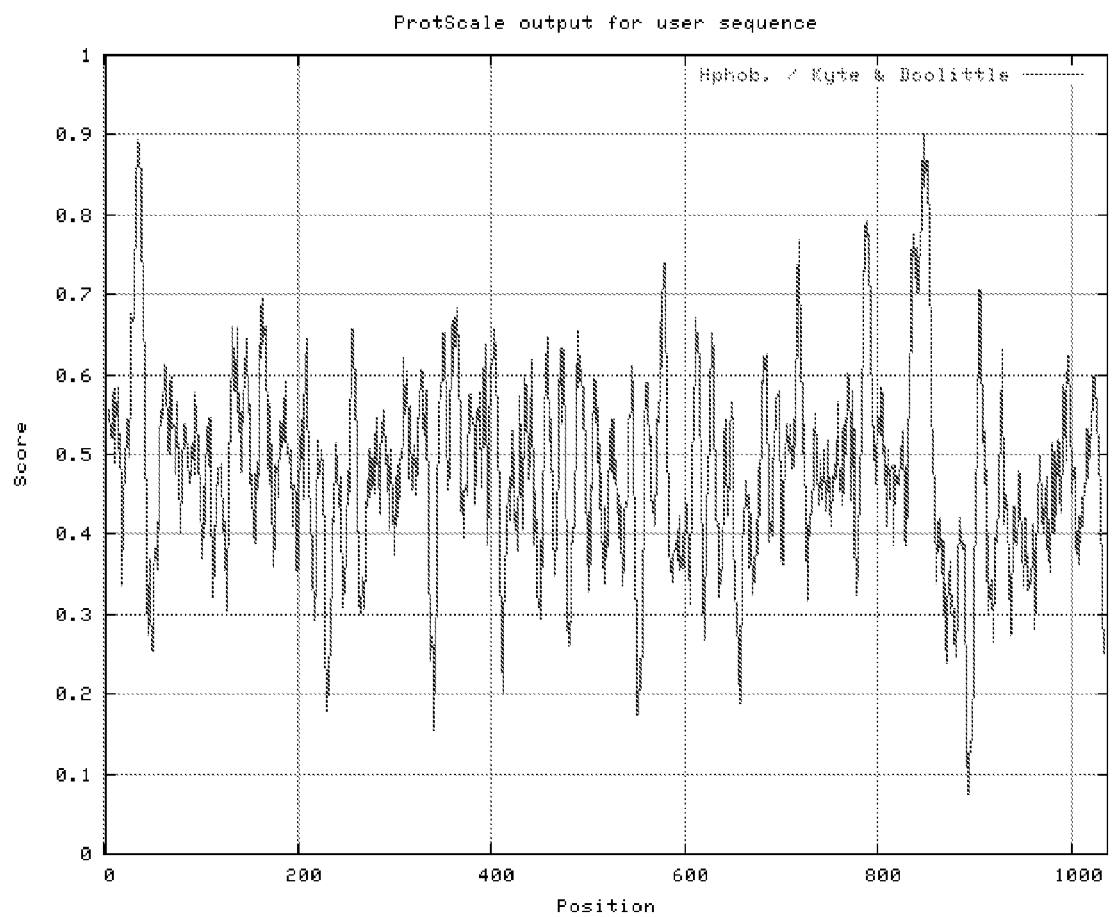
Figure 6i: 109P1D4 variant 9
Hydropathicity Profile
(Kyte J., Doolittle R.F., 1982. J. Mol. Biol. 157:105-132)

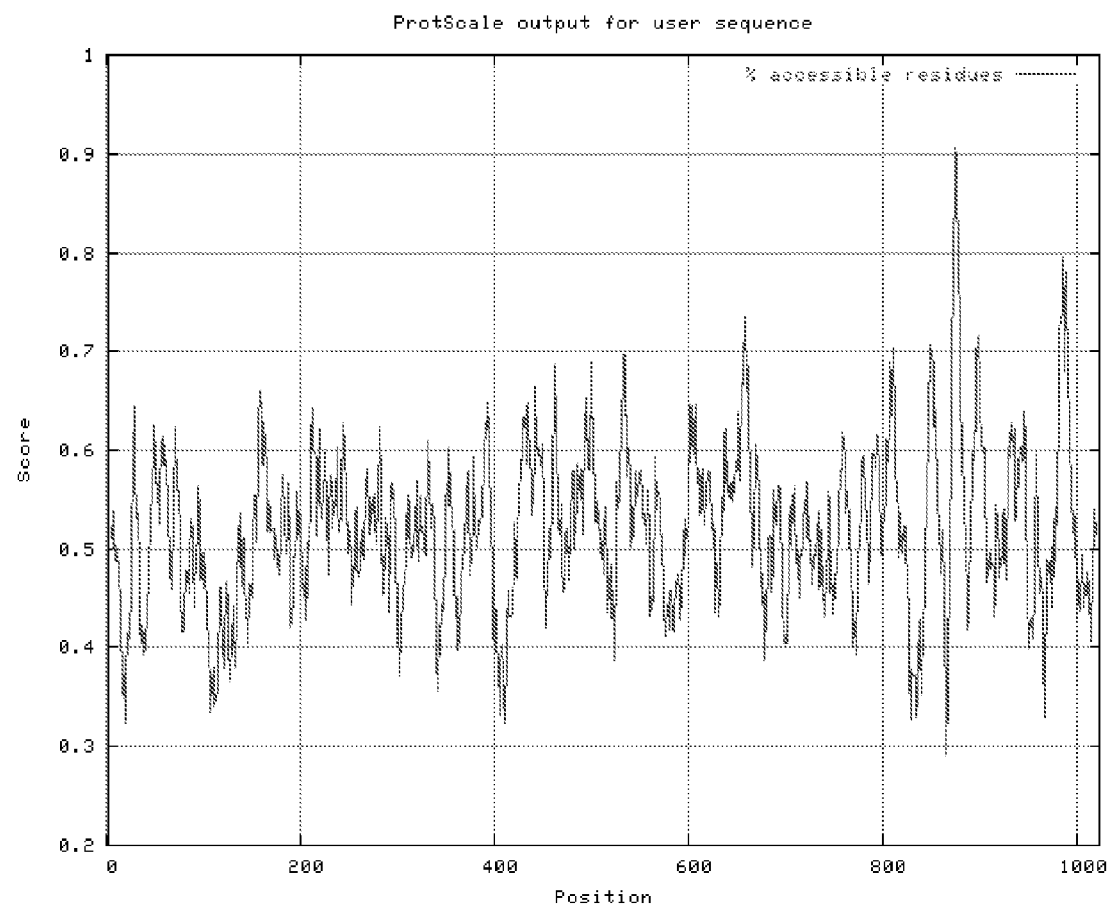
Figure 7a: 109P1D4 variant 1 % Accessible Residues Profile
(Janin J., 1979. Nature 277:491-492)

Figure 7b: 109P1D4 variant 2 % Accessible Residues Profile
(Janin J., 1979. Nature 277:491-492)
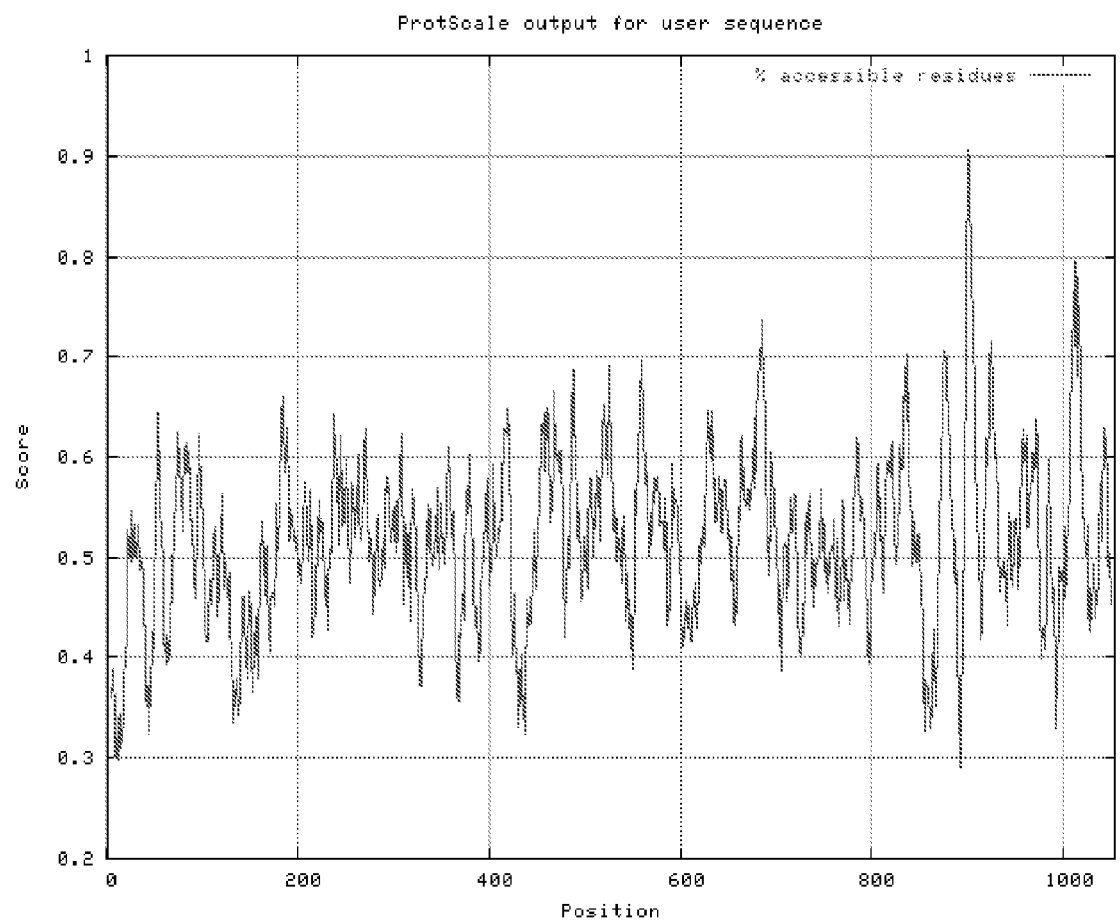

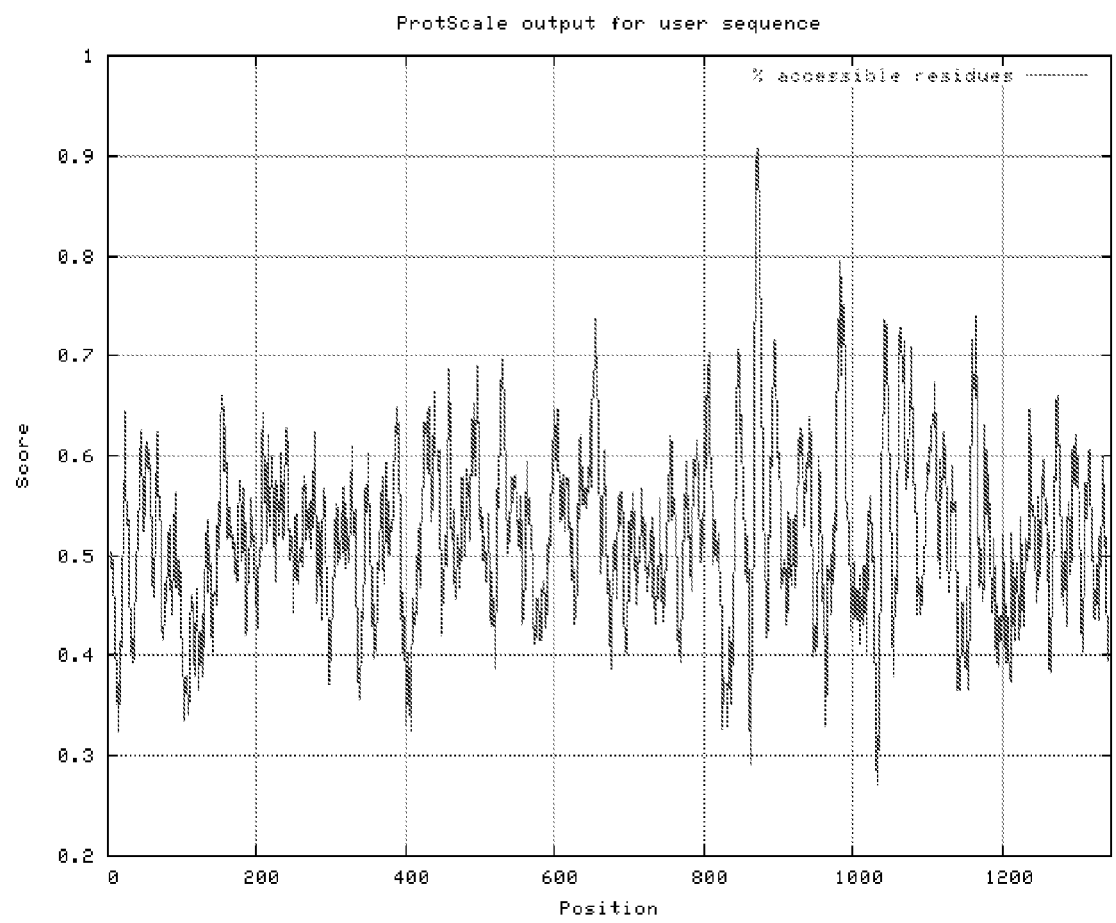
Figure 7c: 109P1D4 variant 3 % Accessible Residues Profile
(Janin J., 1979. Nature 277:491-492)

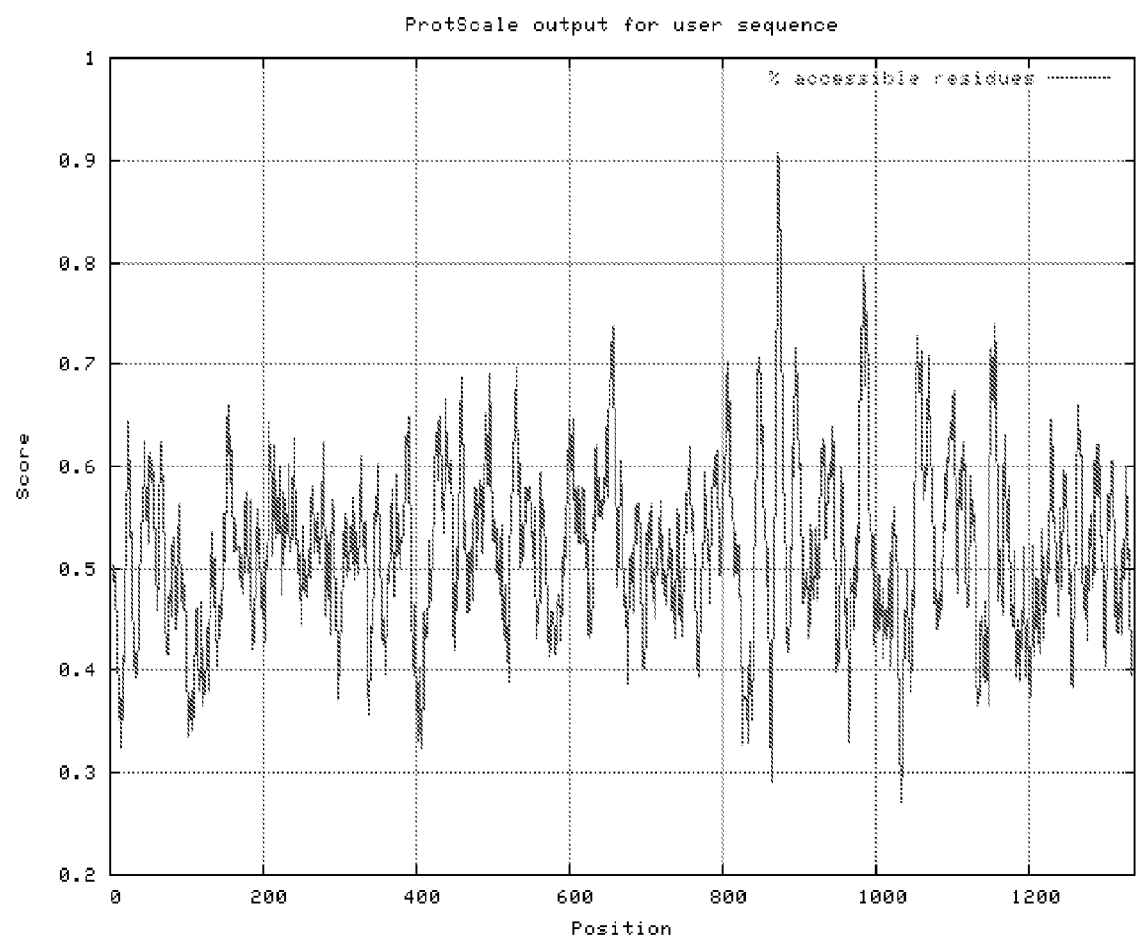
Figure 7d: 109P1D4 variant 4 % Accessible Residues Profile
(Janin J., 1979. Nature 277:491-492)

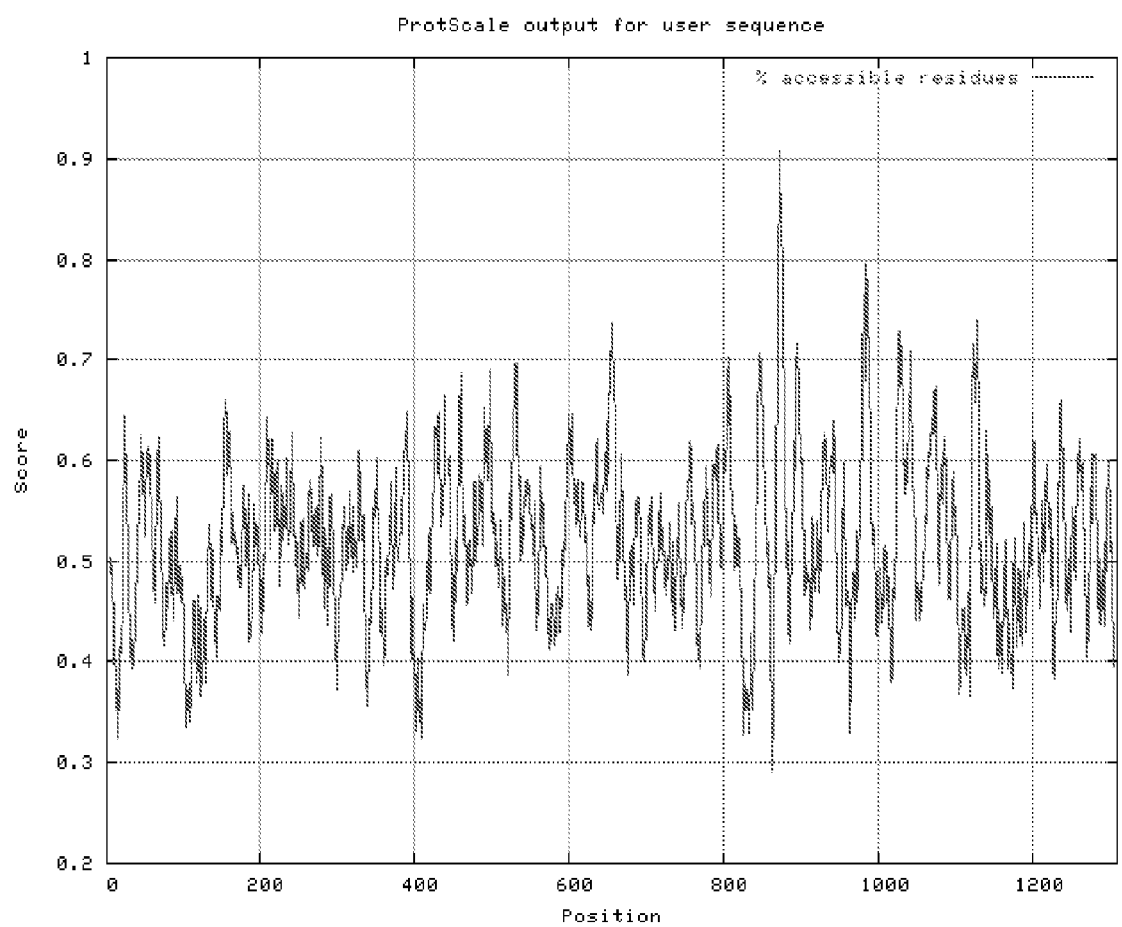
Figure 7e: 109P1D4 variant 5 % Accessible Residues Profile
(Janin J., 1979. Nature 277:491-492)

Figure 7f: 109P1D4 variant 6 % Accessible Residues Profile
(Janin J., 1979. Nature 277:491-492)
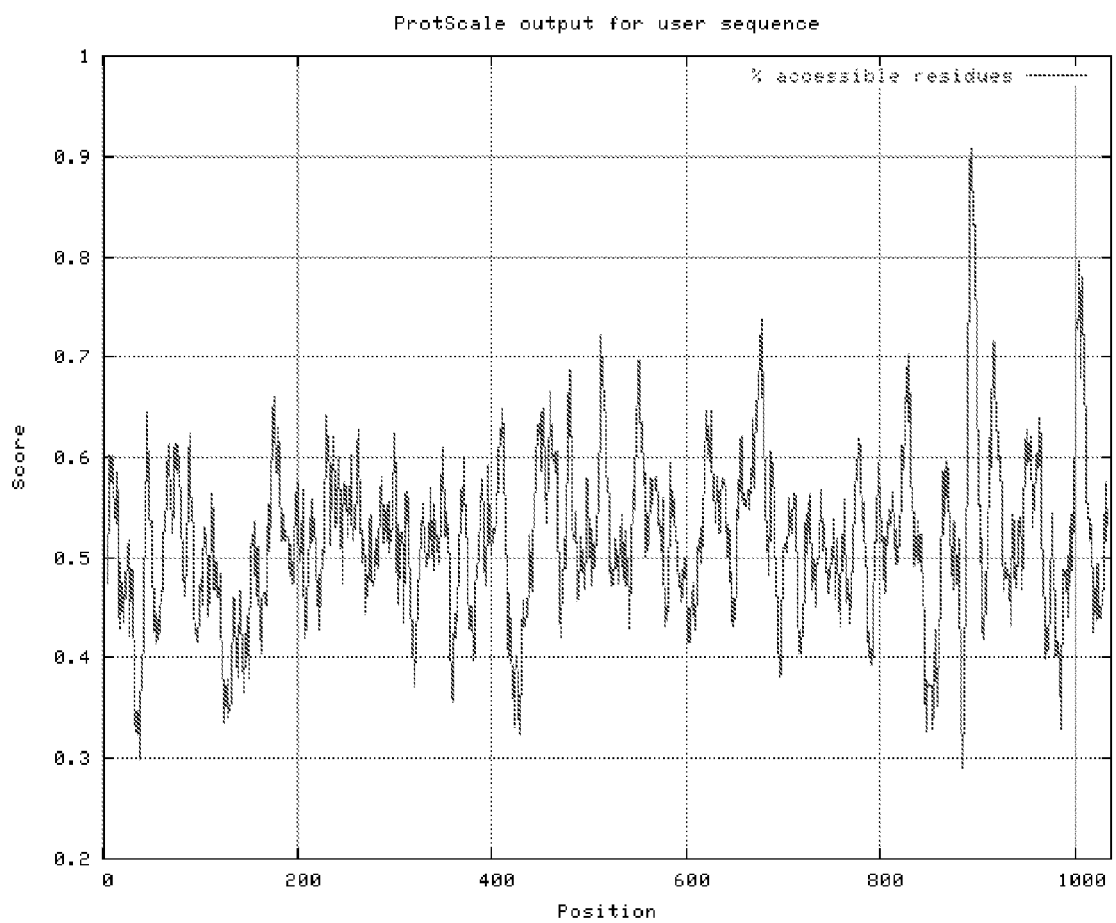

Figure 7g: 109P1D4 variant 7 % Accessible Residues Profile
(Janin J., 1979. Nature 277:491-492)
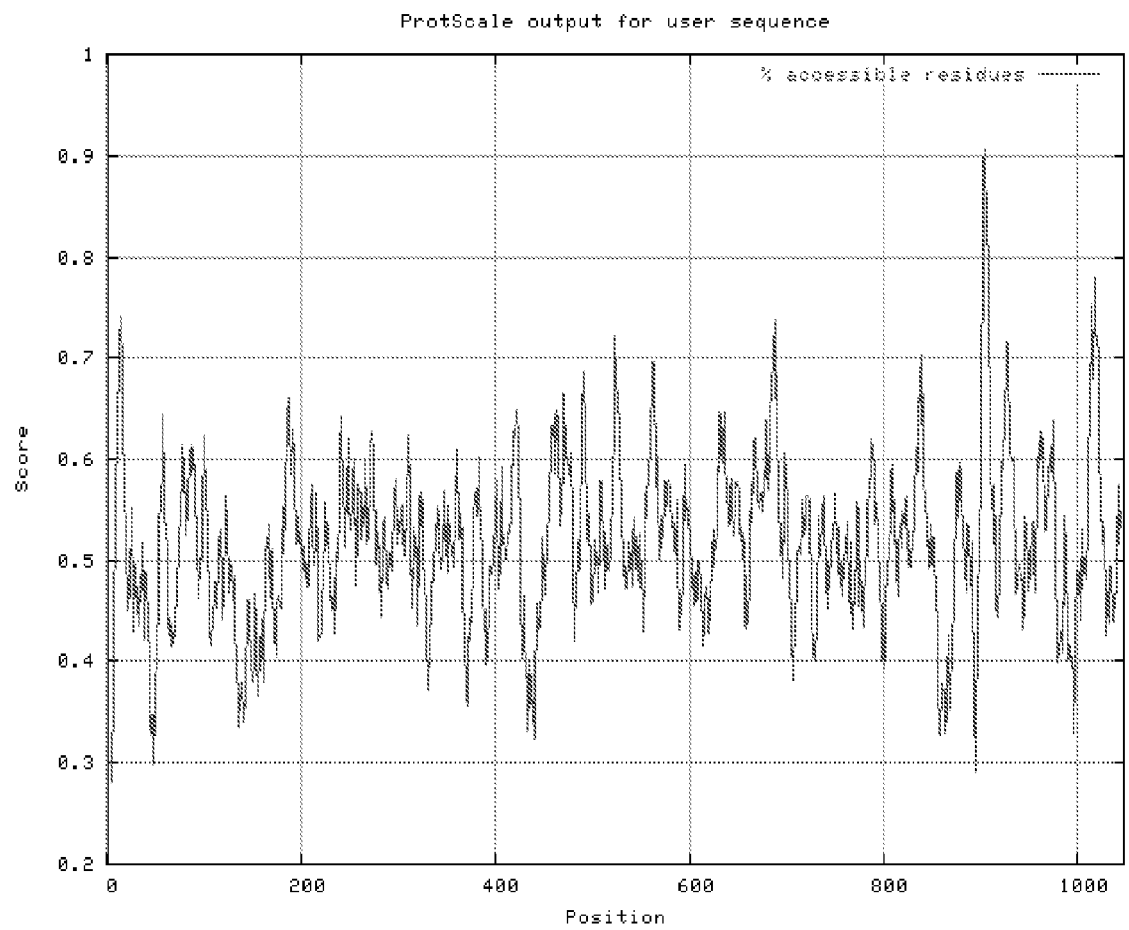

Figure 7h: 109P1D4 variant 8 % Accessible Residues Profile
(Janin J., 1979. Nature 277:491-492)
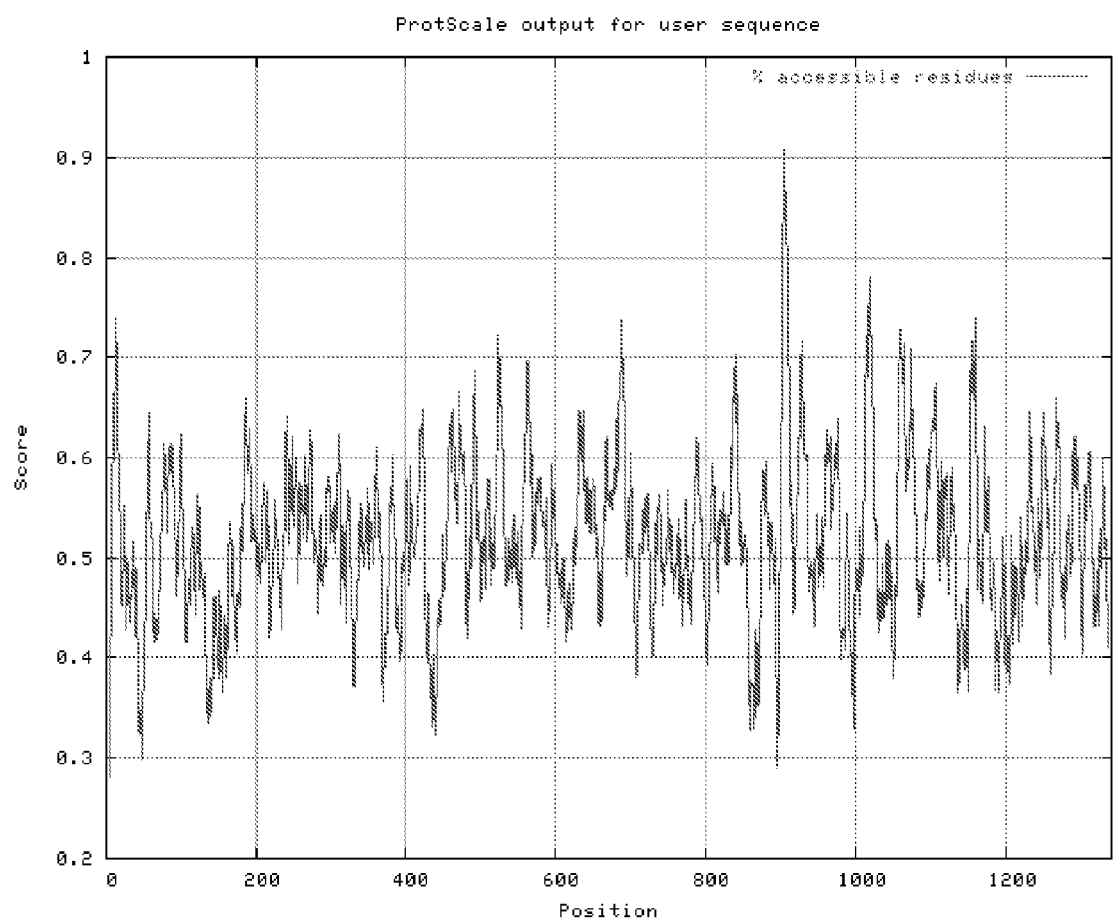

Figure 7i: 109P1D4 variant 9 %
Accessible Residues Profile
(Janin J., 1979. Nature 277:491-492)
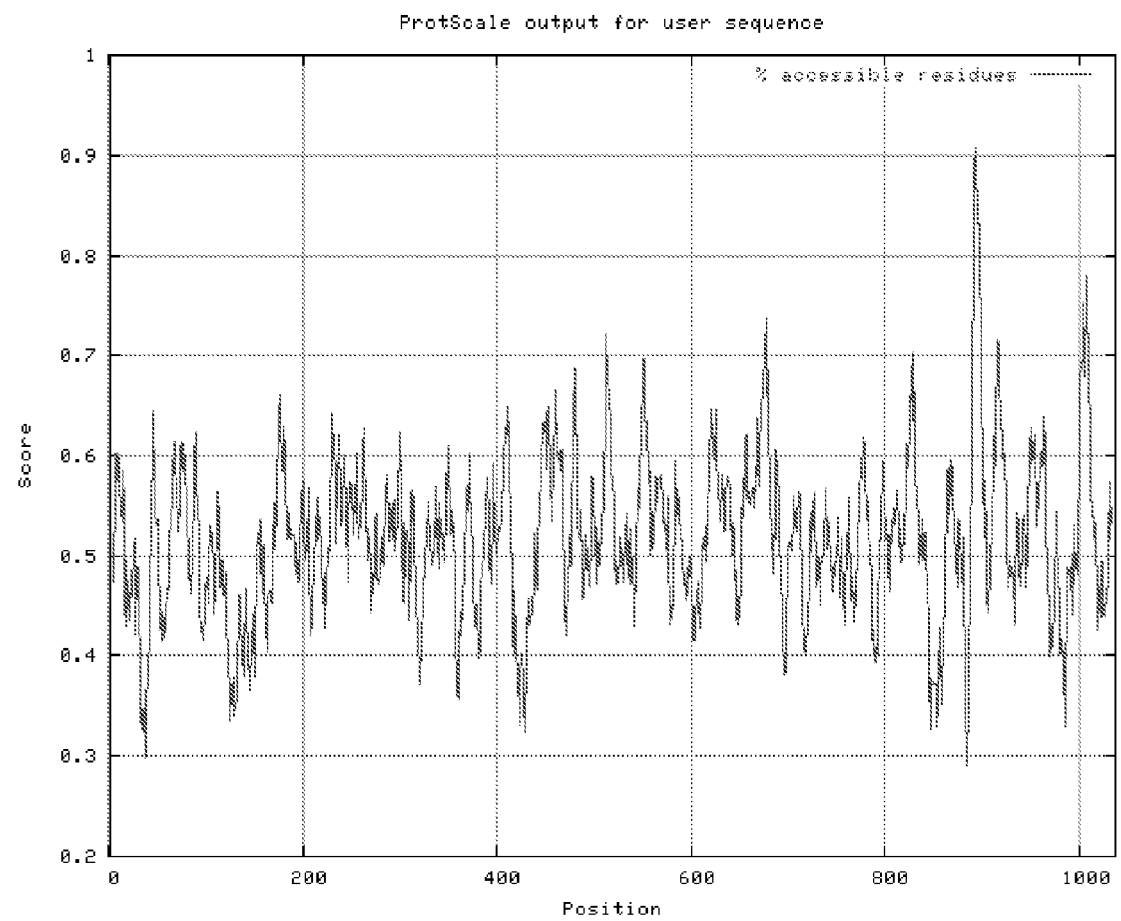

Figure 8a: 109P1D4 variant 1
Average Flexibility Profile
(Bhaskaran R., Ponnuswamy P.K., 1988.
Int. J. Pept. Protein Res. 32:242-255)
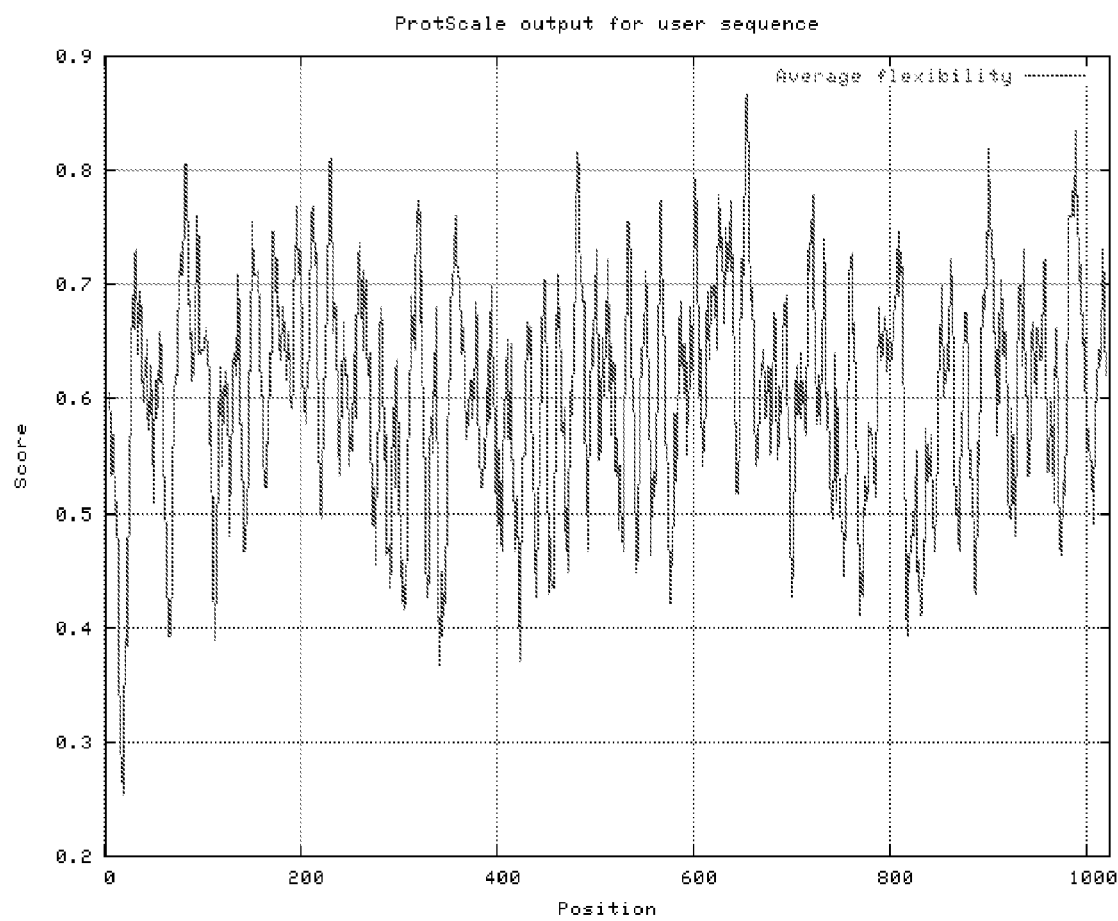

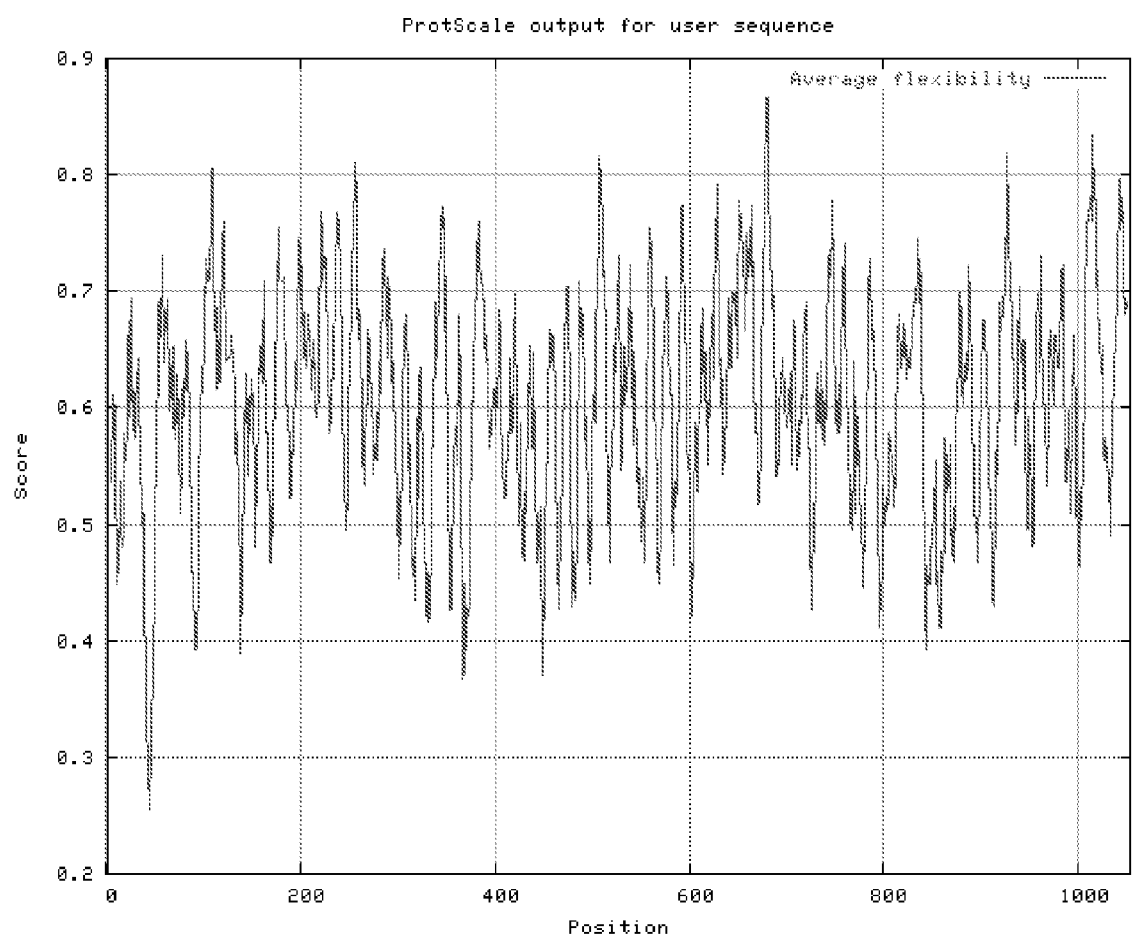
Figure 8b: 109P1D4 variant 2
Average Flexibility Profile
(Bhaskaran R., Ponnuswamy P.K., 1988.
Int. J. Pept. Protein Res. 32:242-255)

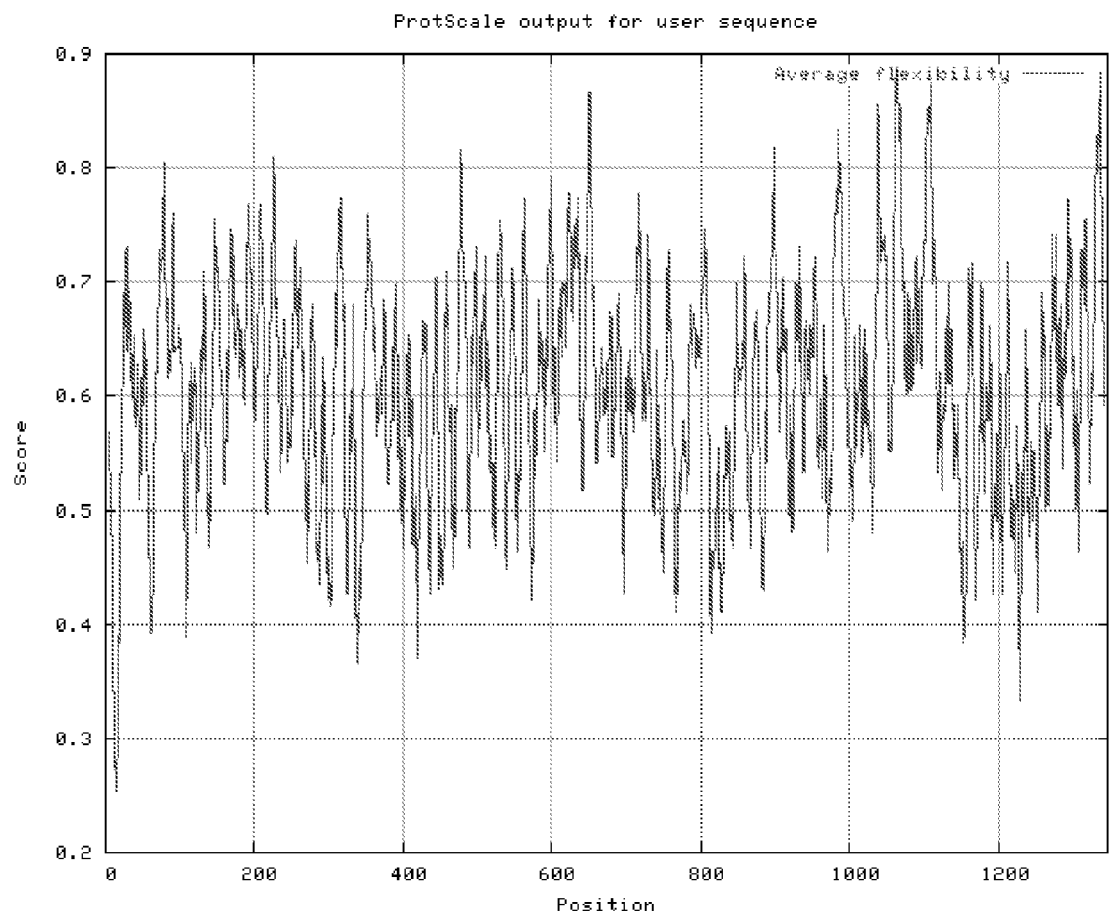
Figure 8c: 109P1D4 variant 3
Average Flexibility Profile
(Bhaskaran R., Ponnuswamy P.K., 1988.
Int. J. Pept. Protein Res. 32:242-255)

Figure 8d: 109P1D4 variant 4
Average Flexibility Profile
(Bhaskaran R., Ponnuswamy P.K., 1988.
Int. J. Pept. Protein Res. 32:242-255)
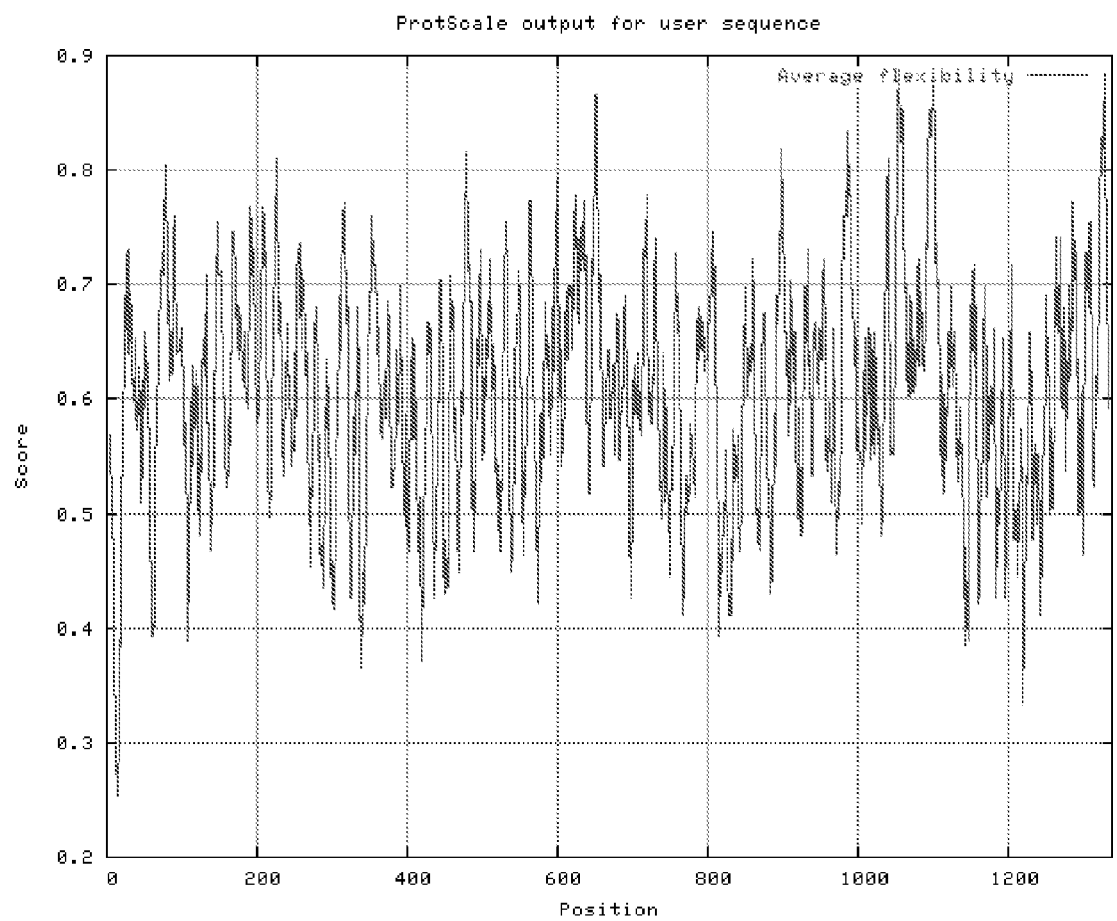

Figure 8e: 109P1D4 variant 5
Average Flexibility Profile
(Bhaskaran R., Ponnuswamy P.K., 1988.
Int. J. Pept. Protein Res. 32:242-255)
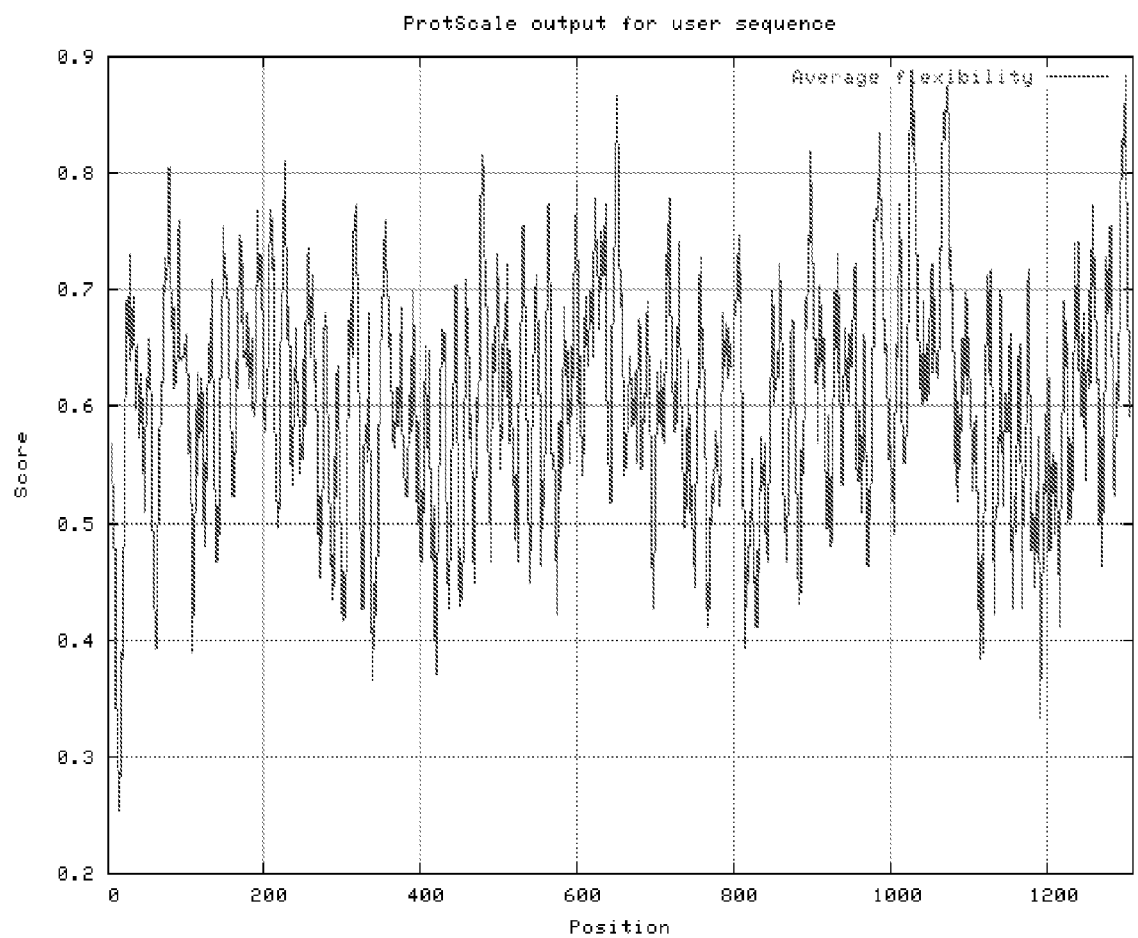

Figure 8f: 109P1D4 variant 6
Average Flexibility Profile
(Bhaskaran R., Ponnuswamy P.K., 1988.
Int. J. Pept. Protein Res. 32:242-255)
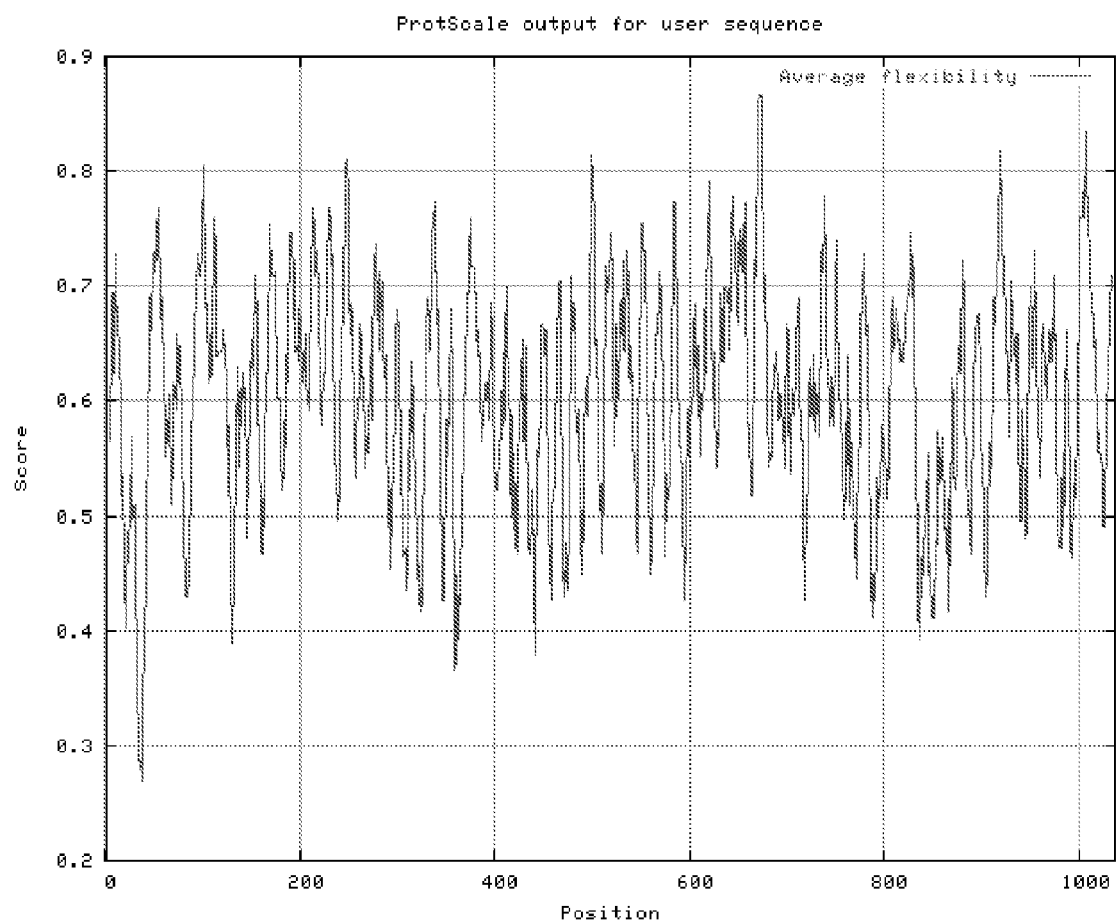

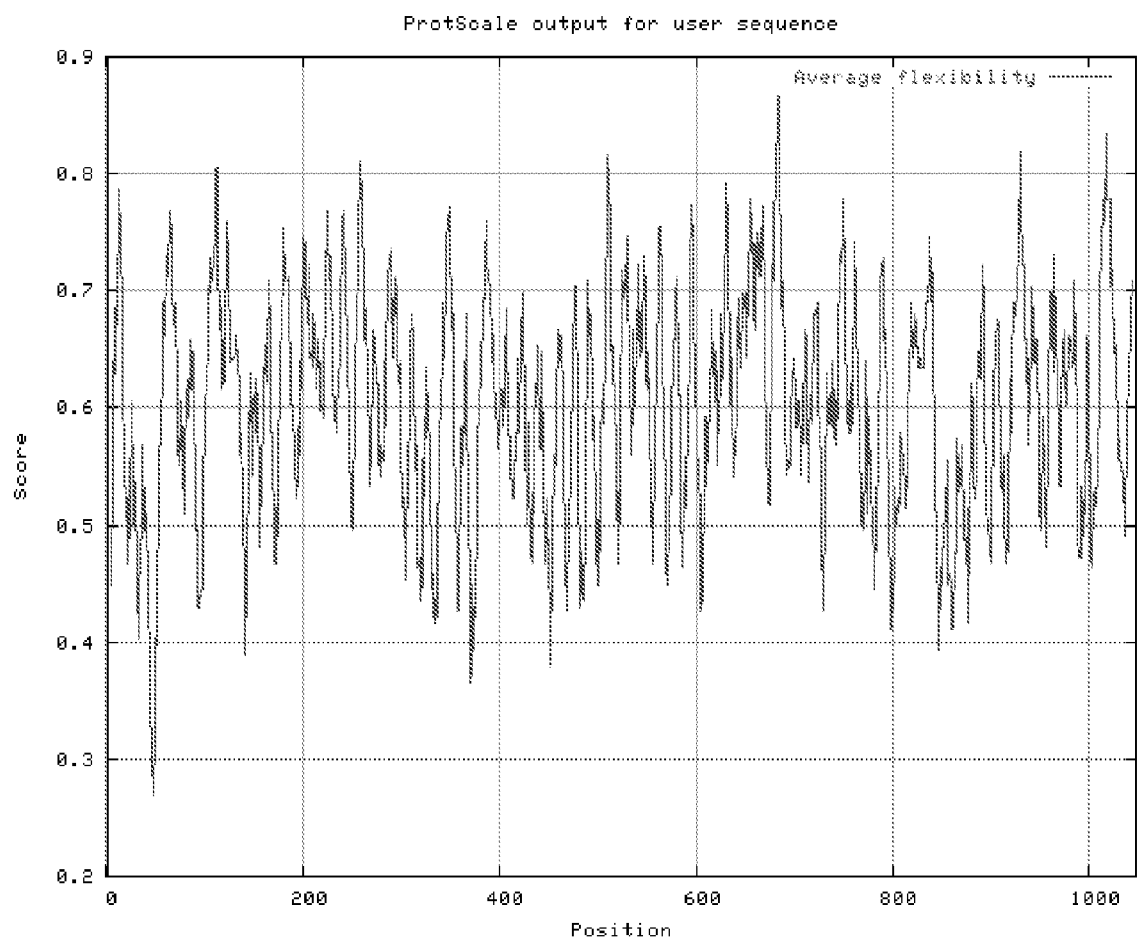
Figure 8g: 109P1D4 variant 7
Average Flexibility Profile
(Bhaskaran R., Ponnuswamy P.K., 1988.
Int. J. Pept. Protein Res. 32:242-255)

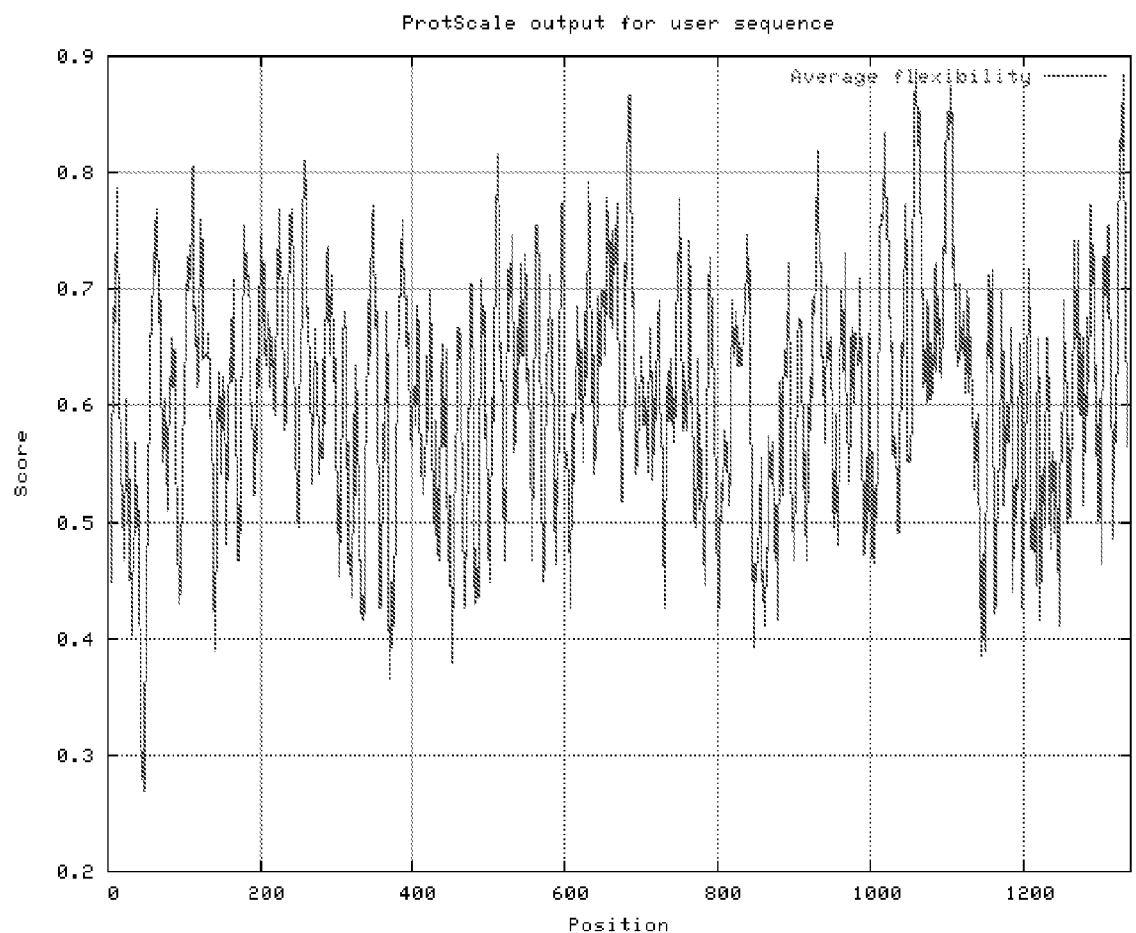
Figure 8h: 109P1D4 variant 8
Average Flexibility Profile
(Bhaskaran R., Ponnuswamy P.K., 1988.
Int. J. Pept. Protein Res. 32:242-255)

Figure 8i: 109P1D4 variant 9
Average Flexibility Profile
(Bhaskaran R., Ponnuswamy P.K., 1988.
Int. J. Pept. Protein Res. 32:242-255)
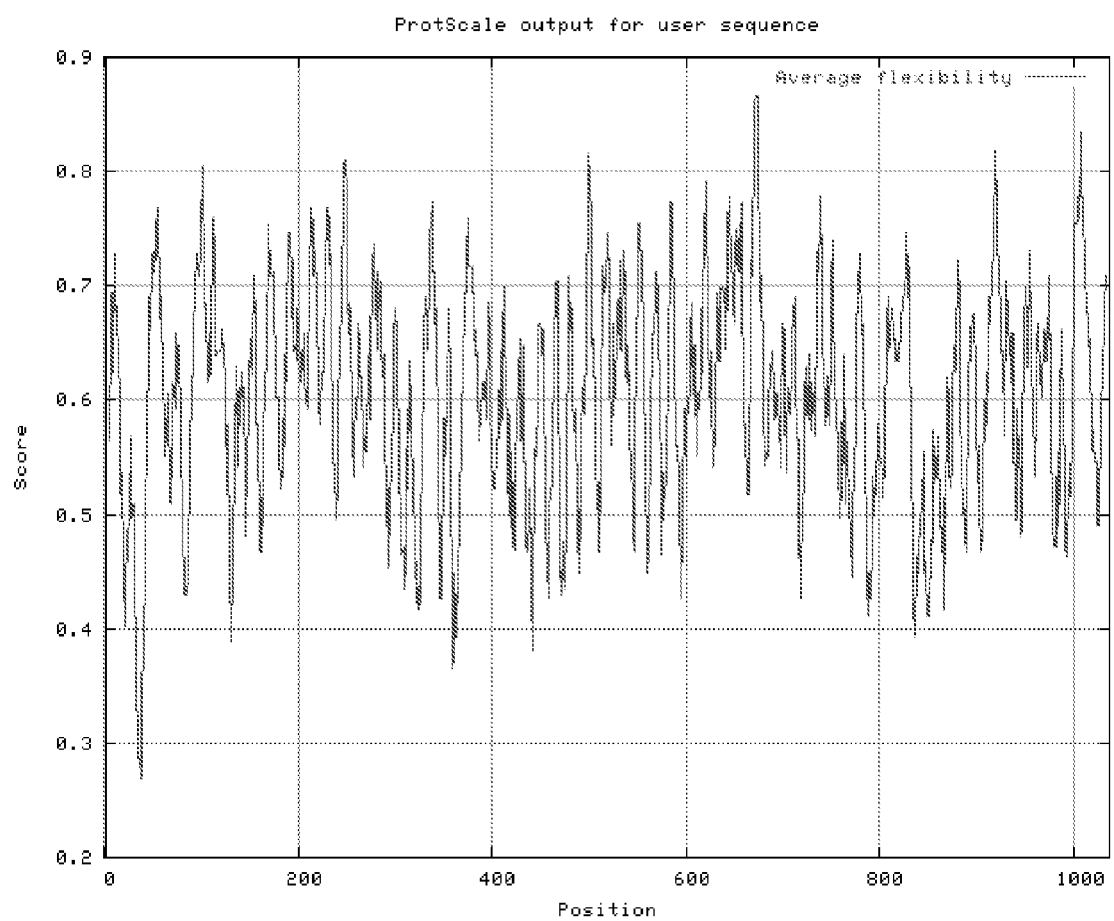

Figure 9a: 109P1D4 variant 1
Beta-turn Profile
(Deleage, G., Roux B. 1987. Protein Engineering 1:289-294)
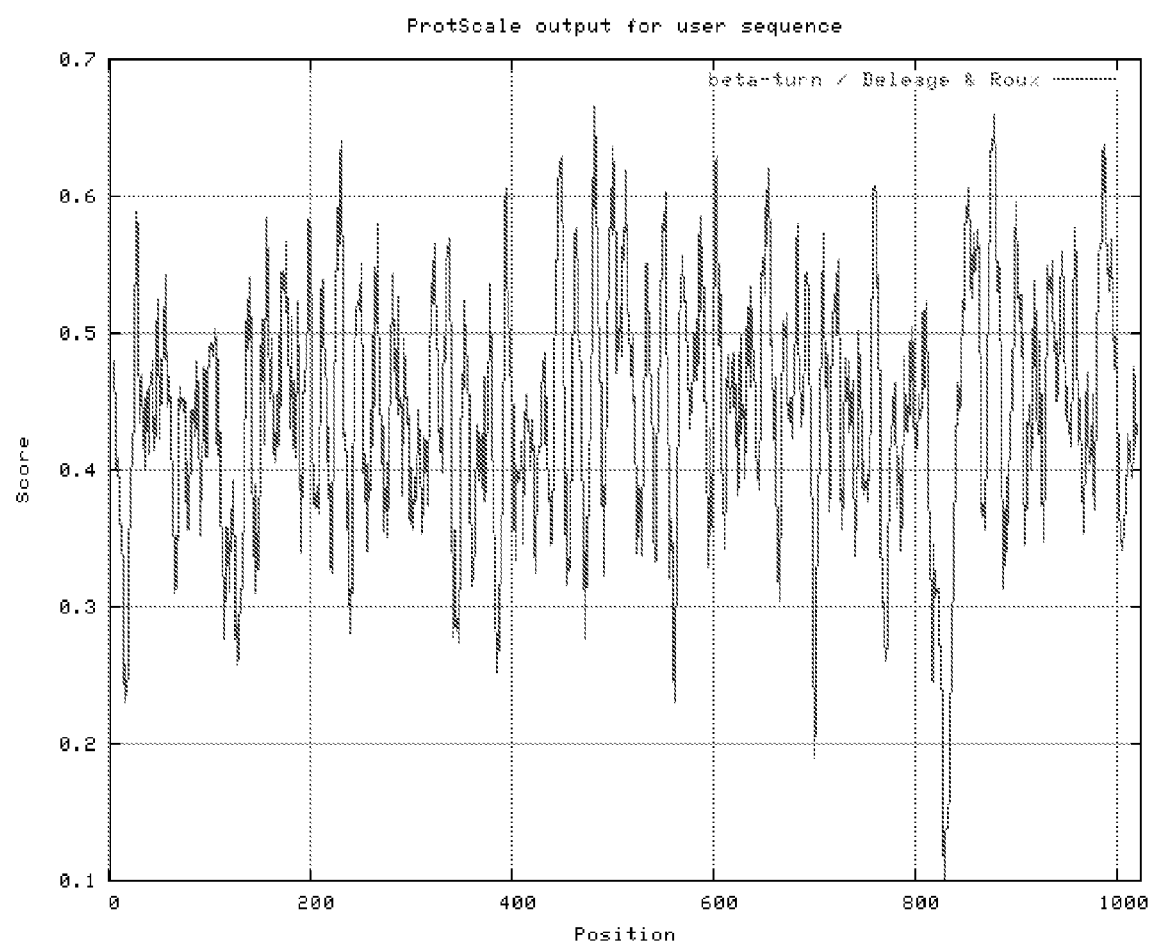

Figure 9b: 109P1D4 variant 2
Beta-turn Profile
(Deleage, G., Roux B. 1987. Protein Engineering 1:289-294)
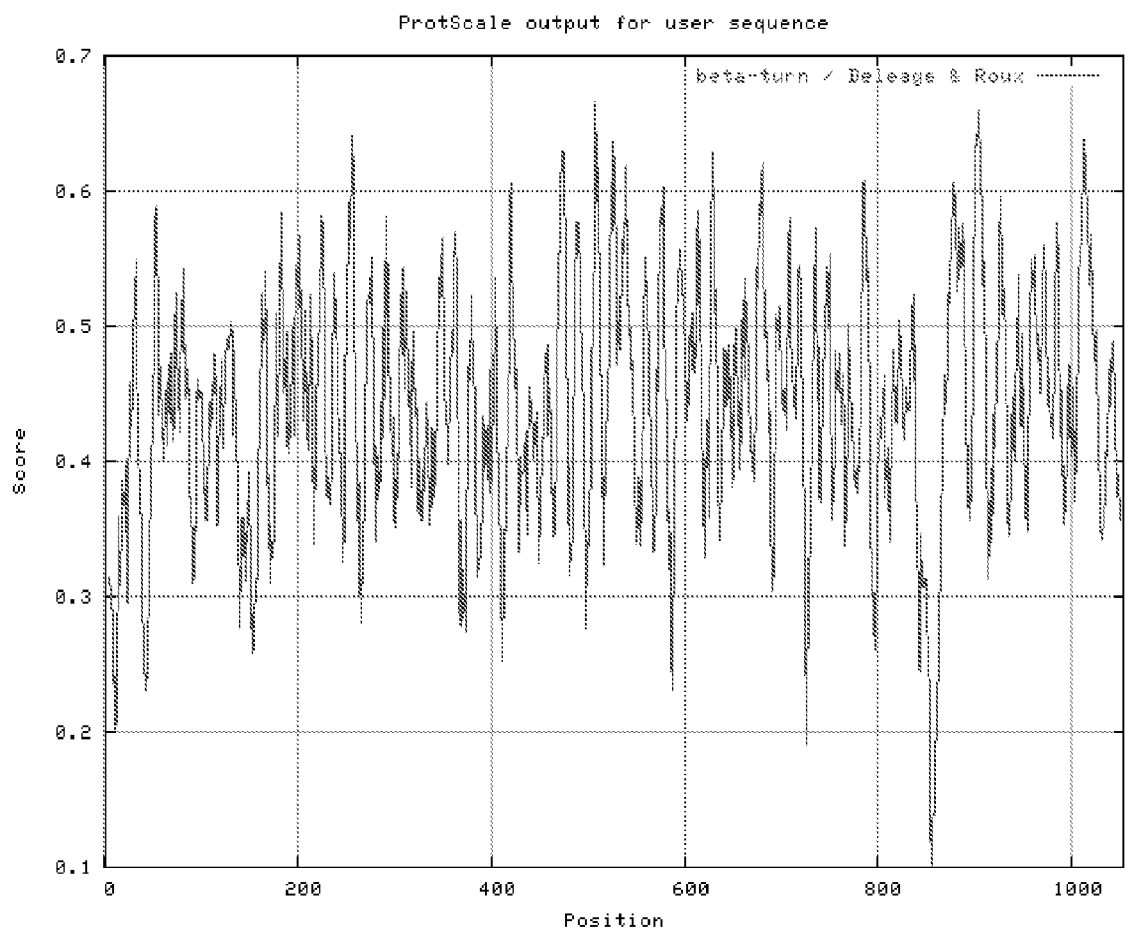

Figure 9c: 109P1D4 variant
3 Beta-turn Profile
(Deleage, G., Roux B. 1987. Protein Engineering 1:289-294)
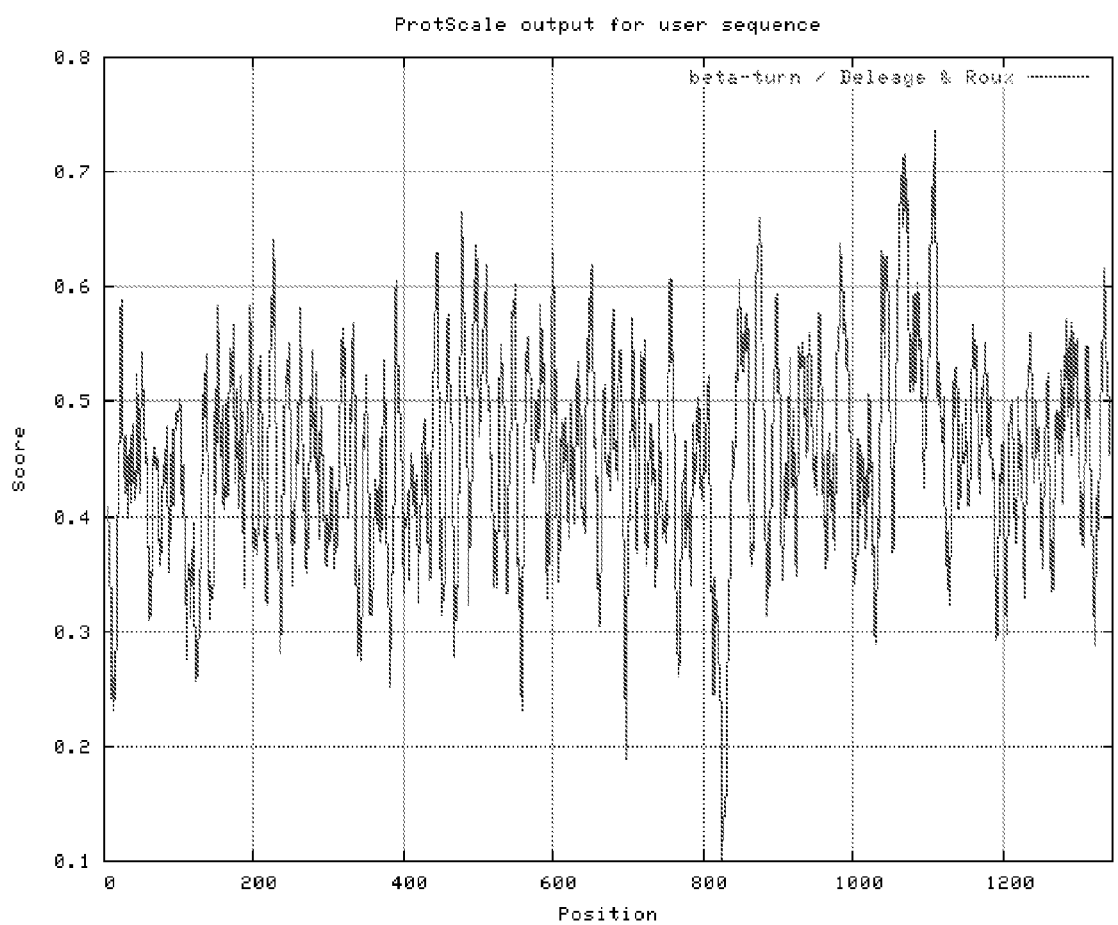

Figure 9d: 109P1D4 variant 4
Beta-turn Profile
(Deleage, G., Roux B. 1987. Protein Engineering 1:289-294)
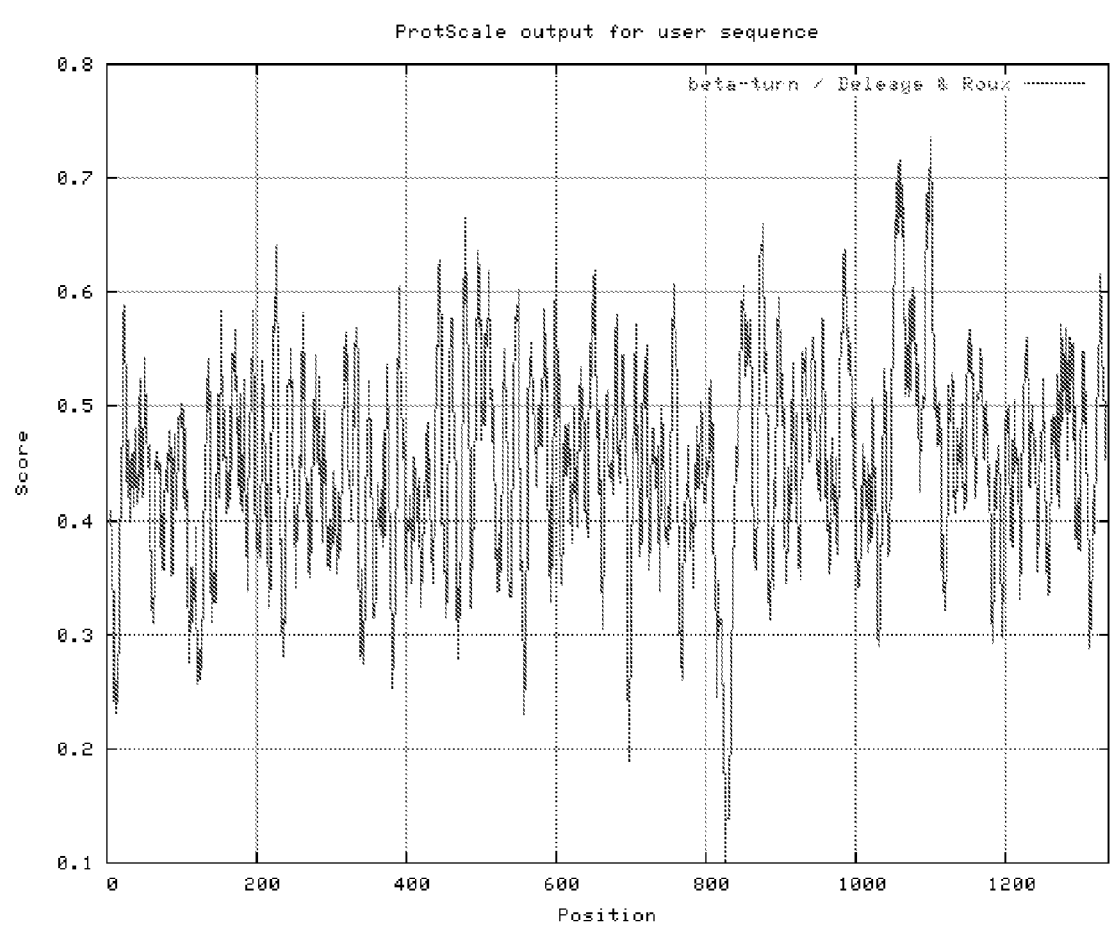

Figure 9e: 109P1D4 variant 5
Beta-turn Profile
(Deleage, G., Roux B. 1987. Protein Engineering 1:289-294)
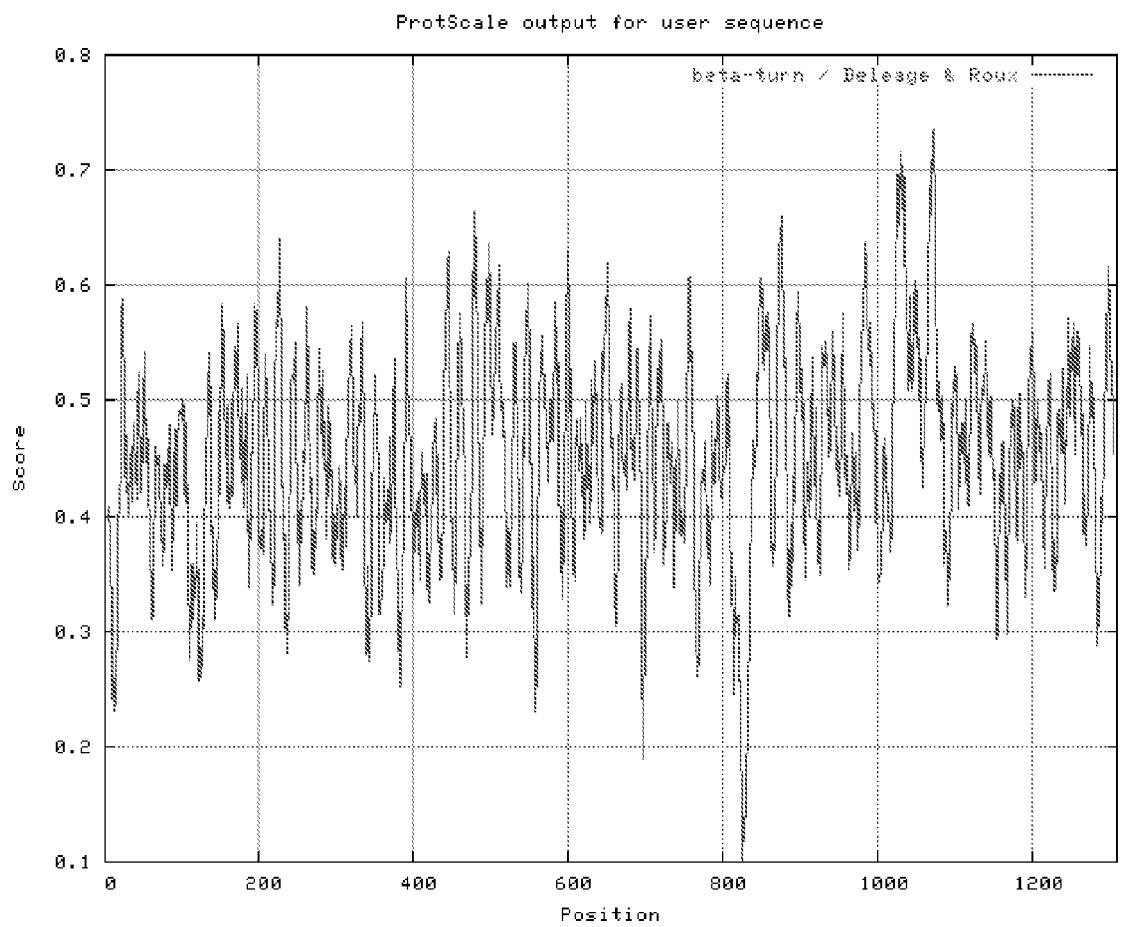

Figure 9f: 109P1D4 variant 6
Beta-turn Profile
(Deleage, G., Roux B. 1987. Protein Engineering 1:289-294)
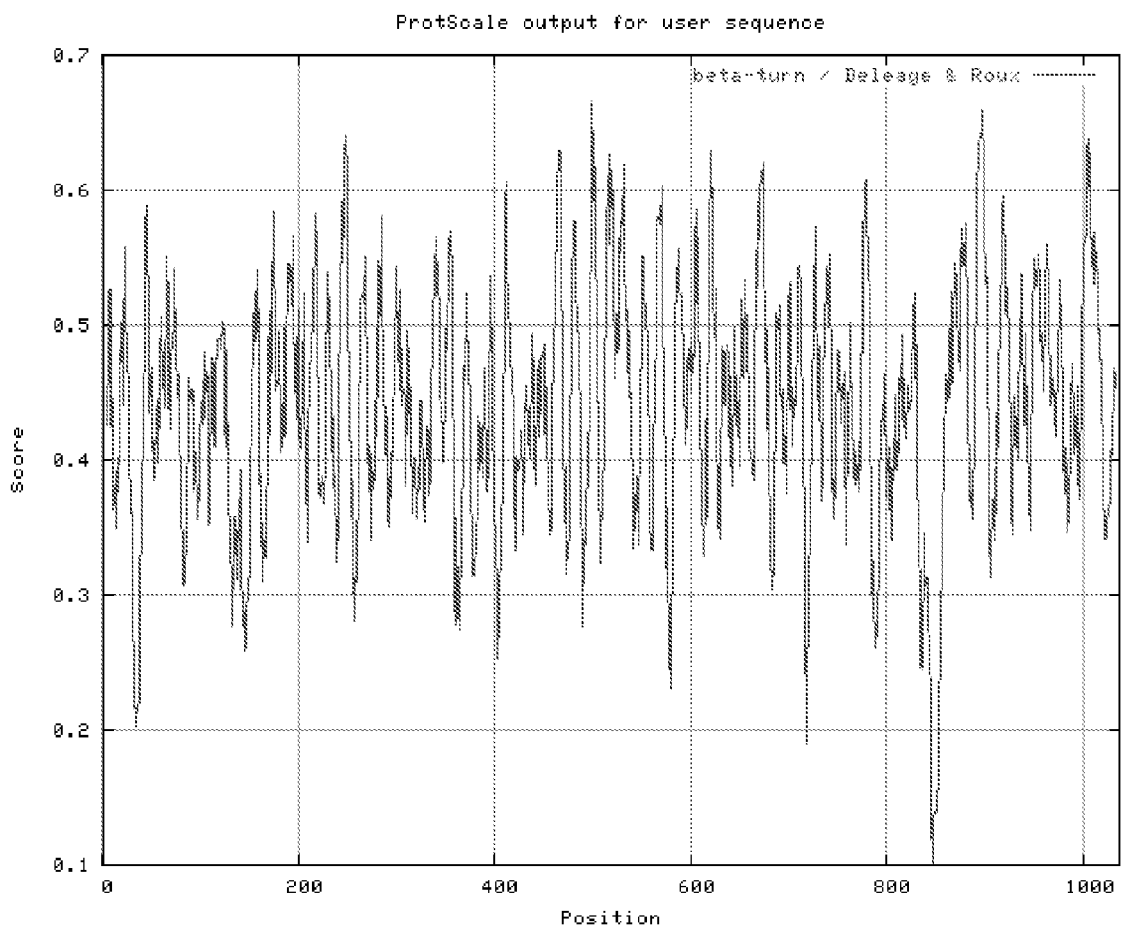

Figure 9g: 109P1D4 variant 7
Beta-turn Profile
(Deleage, G., Roux B. 1987. Protein Engineering 1:289-294)
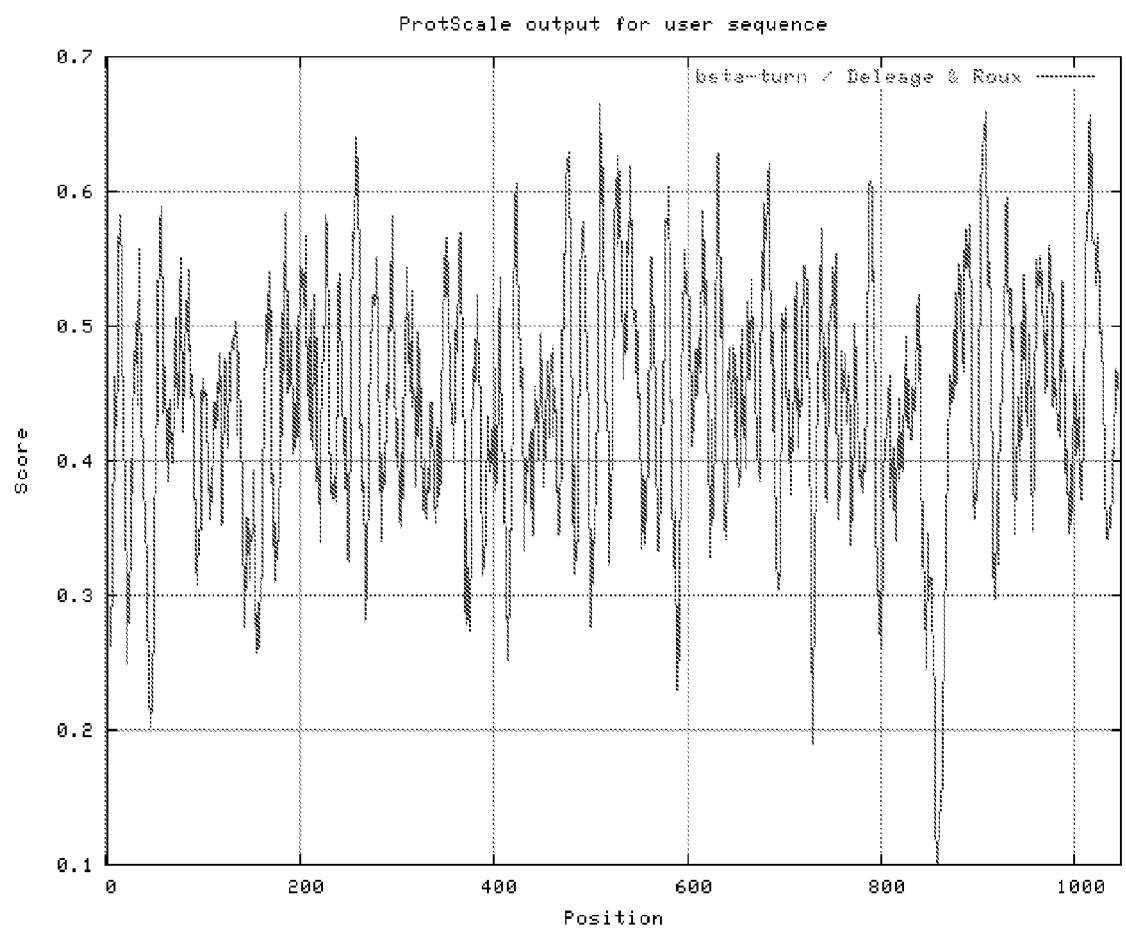

Figure 9h: 109P1D4 variant 8
Beta-turn Profile
(Deleage, G., Roux B. 1987. Protein Engineering 1:289-294)
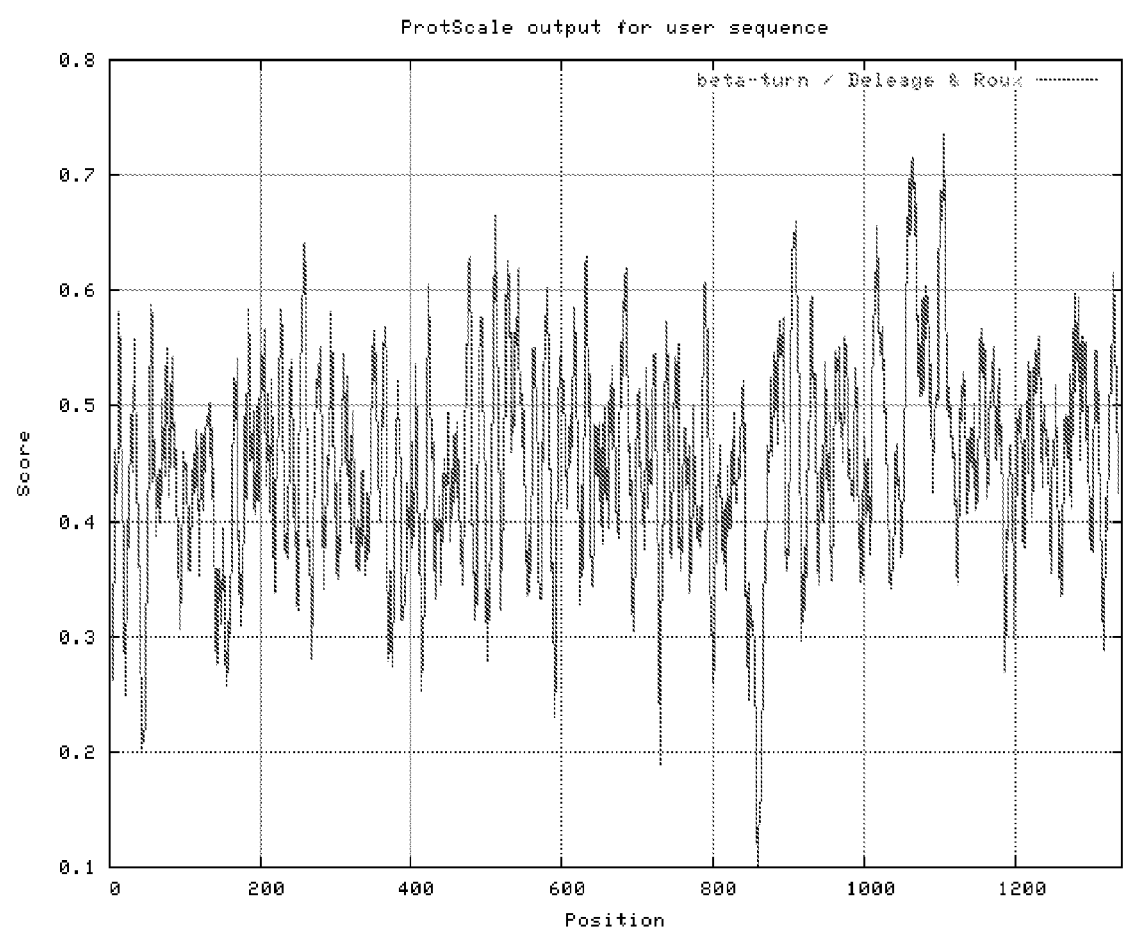

Figure 9i: 109P1D4 variant 9
Beta-turn Profile
(Deleage, G., Roux B. 1987. Protein Engineering 1:289-294)
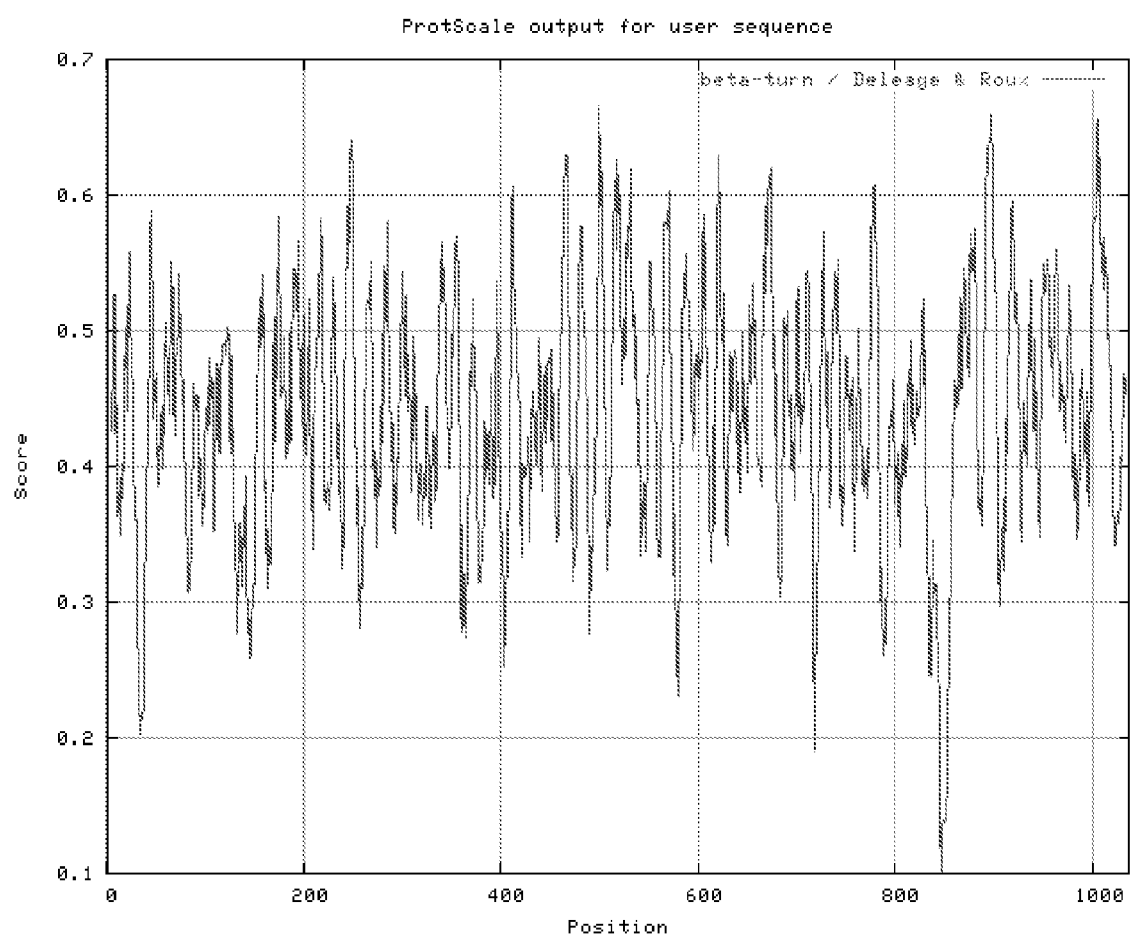

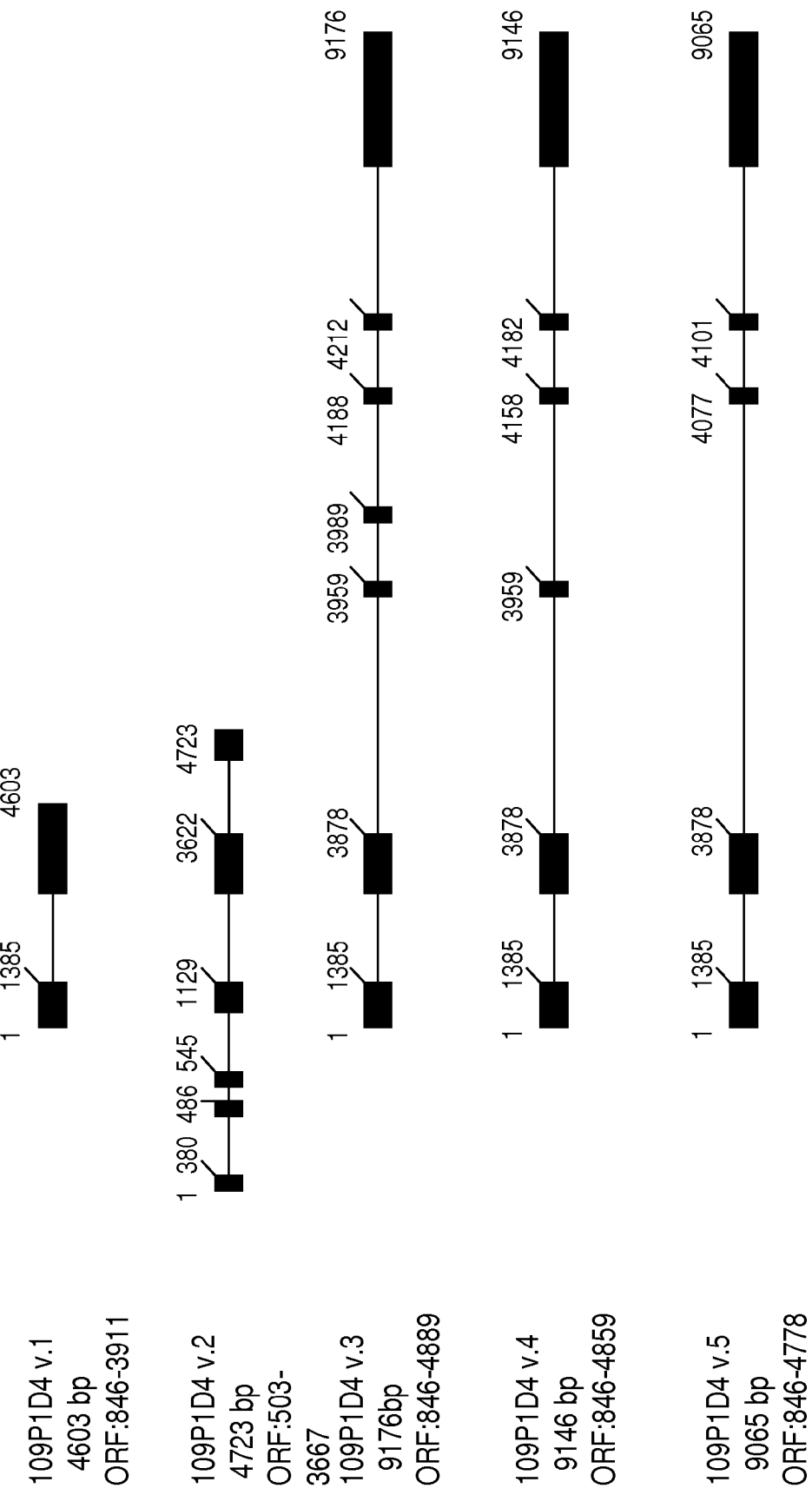

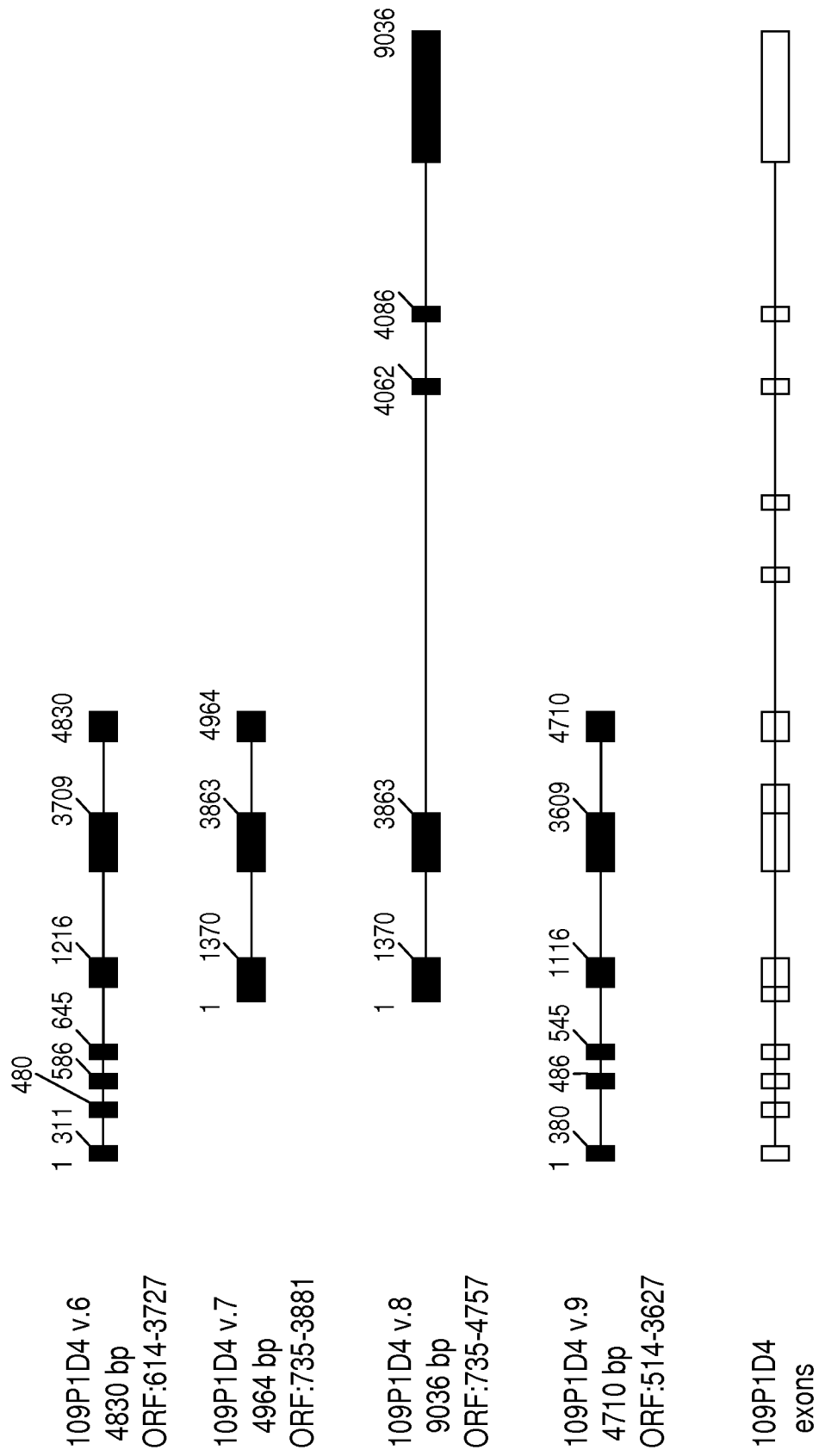

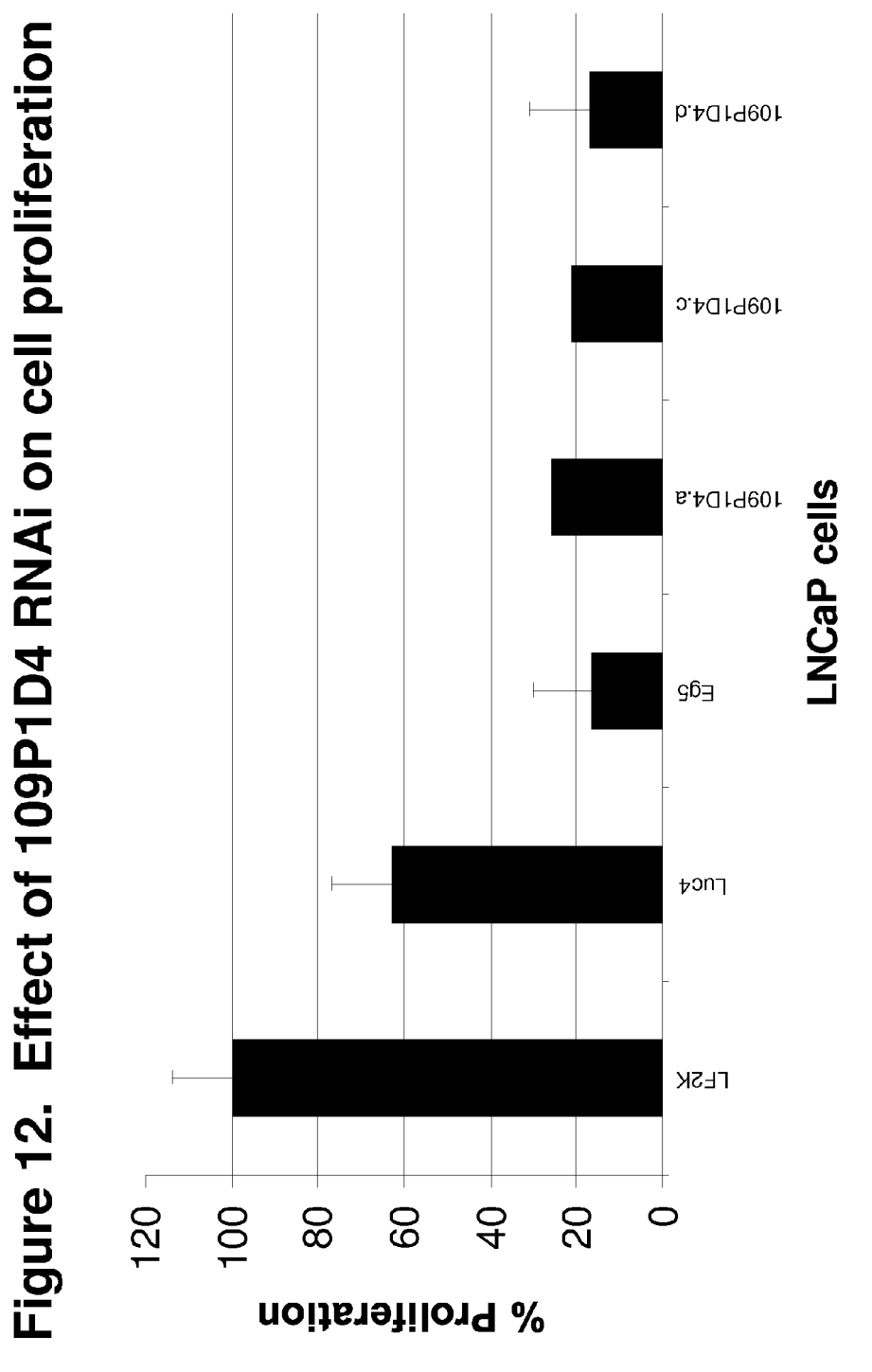
Figure 12. Effect of 109P1D4 RNAi on cell proliferation

Fig. 13A: 109P1D4 variant 1 Secondary Structure

```
         10         20         30         40         50         60         70         80         90        100
          |          |          |          |          |          |          |          |          |          |
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGI
cchhhhhhhhhhhheeccccccccccceeecccccchehhhhhhhcccccccchhhhhhhheeeehcccceeeeeecccceeecccceeeehhhhhhcc PRDEHCFYEVEVAILPDEIFRLVKIRFLIEDINDNAPLFPATVINISIPENSAINSKYTLPAAVDPDVGINGVQNYELIKSQNIFGLDVIETPEGDKMPQ
ccccceeeeeeehhchhhhhhhhhheeeehhhhhccccccccccccccccccccccccccccccccccccccccchheeeecccccceeeeeccccccch LIVQKELDREEKDTYVMKVKVEDGGFPQRSSTAILQVSVTDTNDNHPVFKETEIEVSIPENAPVGTSVTQLHATDADIGENAKIHFSFSNLVSNIARRLF
heehhhhcccceeeeeecccccccccccccceeeccccccceeeeeeeeeccccccccceeeeeeeeccccccceeeeeeeccceeeehhhhhhhhhhh HLNATTGLITIKEPLDREETPNHKLLVLASDGGLMPARAMVLVNVTDVNDNVPSIDIRYIVNPVNDTVVLSENIPLNTKIALITVTDKDADHNGRVTCFT
heccccceeeecccccccccceeeeeecccccccccceeeeeeeeeeeeccccceeeeeeeeeeccccceeeeeeeeeeeecccccccccceeeeeeec DHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAK
ccccccccccccchcchhhhhhhcccccchhhhccccccccccccchhheeeeccccccccceeeeeeeeeeeeeeecccccceeeeeeeecccccccc INYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYG
eeeecccccccccccccccccceeehcccccccccccccceeeeeccccceeeeeeeeecccccccccceeccccccccceeecccccceeeeeecccc DNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIA
cccceeeeeeeeeccccccceeecccccccccccccccceeeecccccccccccceeeeeeeecccccceeeeeccccceeeeeeeccccceeeeeeee VDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEI
ccccccceeeeeeeeeeccccccchheeeeccccccceeeeecccccccccchhheheccccccccchhhhhhhhhhcccccccceeecccccccccccc ADVSSPTSDYVKILVAAVAGTITVVVVIFITAVVRCRQAPHLKAAQKNKQNSEWATPNPENRQMIMKKKKKHSPKNLLLNFVTIEETKADDVDSDG
ccccccchhhhhhhheeeeeecccceeehhhhhhhhhcccchhcccchhhcccccccchhhhhhhhhhhhhhhhccccccceeeeeeecccccccc NRVTLDLPIDLEEQTMGKYNWVTTPTTFKPDSPDLARHYKSASPQPAFQIQPETPLNSKHHIIQELPLDNTFVACDSISKCSSSSDPYSVSDCGYPVTT
cccccccccchccccccceeecccccccccccchhchccccccccccccccccccccccccccccccceeecccccccceeccccccccccccccccee FEVPVSVHTRPVGIQVSNTTF
eeeceeeccccceeeccccc
```

Alpha helix      (h): 16.65%
Extended strand  (e): 29.48%
Random coil      (c): 53.87%

Fig. 13B: 109P1D4 variant 2 Secondary Structure

```
         10         20         30         40         50         60         70         80         90        100
          |          |          |          |          |          |          |          |          |          |

MRTERQWVLIQIFQVLCGLIQQTVTSVPGMDLLSGTYIFAVLLACVVFHSGAQEKNYTIREEMPENVLIGDLLKDLNLSLIPNKSLTTAMQFKLVYKTGD
cchhhhhhhhhhhhhhhhhcccccccccchhchhhhhhhhhheeccccccccchehhhhhhhhhccccccccchhhhhhhhhhhhhhhheeeehcccc VPLIRIEEDTGEIFTTGARIDREKLCAGIPRDEHCFYEVEVAILPDEIFRLVKIRFLIEDINDNAPLFPATVINISIPENSAINSKYTLPAAVDPDVGIN
ceeeeeeecccccccceehhhhhhhhcccccccchhhhhhhhhheeeehchhhhhhhhheeeeeeeccccccccccceeeeccccccccccccccccc GVQNYELIKSQNIFGLDVIETPEGDKMPQLIVQKELDREEKDTYVMKVKVEDGGFPQRSSTAILQVSVTDNDNHPVFKETEIEVSIPENAPVGTSVTQL
ccchheeeeeccccccceeeeeccccccccccccceeehhhhhcccccccccccccccceeeeeeeecccccccccceeeeeeeccccccccccceee HATDADIGENAKIHFSFSNLVSNIARRLFHLNATTGLITTIKEPLDREETPNHKLLVLASDGGLMPARAMVLVNVTDVNDNVPSIDIRYIVNPVNDTVVLS
eccccccccceeehhhhhhhhhhhhhhhhehccccccceeeeeecccccccccccceeeeeeeeccccccccceeeeeeeeccccccccceeeeeeee ENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFV
cccccceeeeeeeccccccceeeeccchhcccccccccccchhhhhhhhhccccchhhhhhhhhhcccceeeeeeeecccccccceeeeeee TVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFT
eeeecccccccccccccccccccceeeeeeeeccccccccccccceehehccccccccccceeehhhhhhhhhhccccccceeeeeeccccccceee HNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKP
ccccceeccccccccceeeeeeecccccceeeeeecccccccccccccccceeecccceeeeeeecccccccccccccccceeeeeeeeccccccc VFIVPPSNCSYELVLPSTNPGTVFQVIAVDNDTGMNAEVRYSIVGGNTRDLFAIDQETGNITLMEKCDVTDLGLHRVLVKANDLGQPDSLFSVVIVNLF
eeeeccccccccceeeeeccccceeeeeeeccccccceeeeeecccccchheeeccccccccceeeecccccceeeeeccchhhhhhhhe VNESVTNATLINELVRKSTEAPVTPNTEIADVSSPTSDYVKILVAAVAGTITVVVIFITAVVRCRQAPHLKAAQKNKQNSEWATPNPENRQMIMKKKK
hcccceeeeeeecccccccccceeeeccccccceeeeeeeehhhhhhcccceeeeeecccchhhhhcccccccchhhhhhhh KKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNT
hhccccccccccccceeecccccccccccccchcccccccccchcccccccccccccccccccccccccccceeeeeeeecccccc FVACDSISKCSSSSSDPYSVSDCGYPVTTFEVPVSVHTRPTDSRTSTIEICSEI                 Alpha helix    (h):17.84%
eeecccccccccccccccccccccceeeeccccccccccccccccccccc                    Extended strand(e):28.65%
                                                                      Random coil    (c):53.51%
```

Fig. 13C: 109P1D4 variant 3 Secondary Structure

```
          10        20        30        40        50        60        70        80        90       100
          |         |         |         |         |         |         |         |         |         |
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGI
cchhhhhhhhhhhheeccccccccccccccccchhhhhhhhhcccccccccchhhhheeeehccccccccceeeeecccccccchhhhhhhcc PRDEHCFYEVEVAILPDEIFRLVKIRFLIEDINDNAPLFPATVINISIPENSAINSKYTLPAAVDPDVGINGVQNYELIKSQNIFGLDVIETPEGDKMPQ
ccccceeeeeehhchhhhheeeehhhhccccccccceeeeecccccccccccccccccchheeeeccceeeeeeeccccccccch LIVQKELDREEKDTYVMKVKVEDGGFPQRSSTAILQVSVTDTNDNHPVFKETEIEVSIPENAPVGTSVTQLHATDADIGENAKIHFSFSNIVSNIARRLF
heehhhhchccccceeeeeecccccccceeeeeeccccccceeeeeccccccceeeeecccccceeehhhhhhhhhhh HLNATTGLITIKEPLDREETPNHKLLVLASDGGLMPARAMVLVNVTDVNDNVPSIDIRYIVNPVNDTVVLSENIPLNTKIALITVTDKDADHNGRVTCFT
heccccceeeeeeccccccccccceeeeeccccccceeeeeeccccccceeeeeeeecccccccceeeeeeeccccccceeeeeec DHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAK
ccccccccchcchhhhhhhhccccceeehhhhhhcccccccceeeeeeeecccccccccceeeeeeeeccccccce INYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYG
eeeeeccccccceeehehcccccccccccccceeeeeccccccceeeeeccccccceeeeccccceeeeecccccc DNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIA
ccceeeeeccccccccccccceeeeeeeeccccccccccceeeeeccccceeeeeccccccceeeeeeeee VDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEI
ecccccceeeeecccccchheeecccccccccchhhehccccccchhhhhhhhchcccccccccc
```

Alpha helix     (h):15.37%
Extended strand (e):25.84%
Random coil     (c):58.80%

Fig. 13C-2

```
         810        820        830        840        850        860        870        880        890        900
          |          |          |          |          |          |          |          |          |          |
ADVSSPTSDYVKILVAAVAGTITVVVIFITAVVRCRQAPHLKAAQKNKQNSEWATPNENRQMIMKKKKKKHSPKNLLLNFVTIEETKADDVDSDG
ccccccchhhhhhhhhhcccceeeeeeeehhhhhchccccchhhhhhhhhccccccccchhhhhhhhhhcccccccccceeeeeeeccccccc
NRVTLDLPIDLEEQTMGKYNWVTTPTTFKPDSPDLARHYKSASPQPAFQIQPETPLNSKHHIIQELPLDNTFVACDSISKCSSSSDPYSVSDCGYPVTT
cccccccccccccccccceeccccccccccccccccccccccccccccccccccccccccceeecccccccccccccccccccccccccccee
FEVPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATP
eeeeeeeccccccccccheeecccccccccccccccccccceeeccccccccccceeeeeeeccccccccccccccccccccccchhccccccc
SNRTEGDGNSDPESTFIPGLKKAAEITVQPTVEEASDNCTQECLIYGHSDACWMPASLDHSSSSQAQASALCHSPPLSQASTQHHSPRVTQTIALCHSPP
cccccccccccccccccccccccchhhccccccccceeccccccccccccccccccccccccccchhhhccccccccccccccccccccccccc
VTQTIALCHSPPPIQVSALHHSPPLVQATALHHSPPSAQASALCYSPPLAQAAAISHSSPLPQVIALHRSQAQSSVSLQQGWVQGADGLCSVDQGVQGSA
ccceeeeeecccccccccccceeccccccccccccccccchhhhhccccccccccccccceeeccccccccccccccccccccccccccccccc
TSQFYTMSERLHPSDDSIKVIPLTTFTPRQQARPSRGDSPIMEEHPL
chhhhhhcccccccccceeeeeecccccccccccccccccccccccc Alpha helix      (h) :15.37%
             Extended strand  (e) :25.84%
             Random coil      (c) :58.80%
```

Fig. 13D: 109P1D4 variant 4 Secondary Structure

```
         10         20         30         40         50         60         70         80         90        100
          |          |          |          |          |          |          |          |          |          |
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGI
cchhhhhhhhhhheeccccccccccccccccccceeeeeecccchehhhhhhhcccccccccchhhhhhheeeehccccceeeehcccccccchhhhhcc PRDEHCFYEVEVAILPDEIFRLVKIRFLIEDINDNAPLFPATVINISIPENSAINSKYTLPAAVDPDVGINGVQNYELIKSQNIFGLDVIETPEGDKMPQ
cccccccceeeeehhcchhhhhhhheeeeeehhhhhcccccccceeeeeecccccccccccccccccccchheeeccceeeeeeeeeeecccccccchh LIVQKELDREEKDTYVMKVKVEDGGFPQRSSTAILQVSVTDTNDNHPVFKETEIEVSIPENAPVGTSVTQLHATDADIGENAKIHFSFSNLVSNIARRLF
heehhhhchccccceeeeeeecccccccccccceeeeecccccccccccccceeeecccccccccccccccceeeeeeehhhhhhhhhhh HLNATTGLITIKEPLDREETPNHKLLVLASDGGLMPARAMVLVNVTDVNDNVPSIDIRYIVNPVNDTVVLSENIPLNTKIALITVTDKDADHNGRVTCFT
heccccceeeeeccccccccccccccccceeeeeeccccccccccccccccceeeeeeecccccceeeeeeeeecccccccccccceeeeeeeeec DHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAK
cccccccccccccchhhhhhhhhhhhccccchhhhhhhhhccccccccchhhheeeeecccccccceeeeeeeeeeccccccccceeeeeccccccce INYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYG
eeeeeecccccccccccccccccehcccccccccccceeeeeecccccccccccccccceeeeecccccccccccceeeeeeeccccccceeeeeeee DNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIA
cccccccceeeccccccccccccccccccccccccccccceeeccccccccccceeccccccccccccccccccccceeeeeeeeccccccceeeeee VDNDTGMNAEVRYSIVGGNTRDLFAIDQETGNIITLMEKCDVTDLGLHRVLVKANDLGQPDSLFSVVIVNLFVNESVTNATLINELVRKSTEAPVTPNTEI
eccccccceeeecccccchheeecccccccccccchhehccccccccccccchhhhhhhhhhhcccccccccccccc
```

```
Alpha helix       (h) :15.48%
Extended strand   (e) :25.88%
Random coil       (c) :58.64%
```

Fig. 13D-2

```
         810        820        830        840        850        860        870        880        890        900
          |          |          |          |          |          |          |          |          |          |
ADVSSPTSDYVKILVAAVAGTITVVVVIFITAVVRCRQAPHLKAAQKNKQNSEWATPNPENRQMIMKKKKKKHSPKNLLLNFVTIEETKADDVDSDG
ccccccchhhhhhhhcccceeeeeeehhhhhhchccchhhhhhhhchccccccccchhhhhhhhhhcccccccceeeeeeeeecccccccccccc
NRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTT
cccccccccccceeeeeeccccccccccccccchhccccccccccccccccccccceeecccccccccccccccccccccccccccccccccccee
FEVPVSVHTRPPMKEVVRSCTPMKESTTMEIWIHPQPQSQRRVTFHLPEGSQESSSDGGLGDHDAGSLTSTSHGLPLGYPQEEYFDRATPSNRTEGDGNS
eeeceeecccccccccccceeeecccccceeeeeeccccccccccccccccccccccccccccccccccccchhccccccccccccccccccccc
DPESTFIPGLKKAAEITVQPTVEEASDNCTQECLIYGHSDACWMPASLDHSSSSQAQASALCHSPPLSQASTQHHSPRVTQTIALCHSPPVTQTIALCHS
cccchhhchhcccccccccccccccccccccccccccceeeeeccccccccccccccccccccccchhhhhccccccccccccccceeeeeeeecc
PPPIQVSALHHSPPLVQATALHHSPPSAQASALCYSPPLAQAAAISHSSPLPQVIALHRSQAQSSVSLQQGWVQGADGLCSVDQGVQGSATSQFYTMSER
ccccccccccccccccccccccccccccccccccccccccccccccccchhhhhchccchhhhhhccccccccccccccccccccccccchhhhccc
LHPSDDSIKVIPLTTFTPRQQARPSRGDSPIMEEHPL
cccccccceeeeccccccccccccccccccccccccc
```

Alpha helix      (h): 15.48%
Extended strand  (e): 25.88%
Random coil      (c): 58.64%

Fig. 13E: 109P1D4 variant 5 Secondary Structure

```
        10         20         30         40         50         60         70         80         90        100
         |          |          |          |          |          |          |          |          |          |
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGI
cchhhhhhhhhhhhheeccccccccccccccccceeecccccccchhhhhhhhhcccccccchhhhhheeehcccccccceeecccccchhhhhhcc PRDEHCFYEVEVAILPDEIFRLVKIRFLIEDINDNAPLFPATVINISIPENSAINSKYTLPAAVDPDVGINGVQNYELIKSQNIFGLDVIETPEGDKMPQ
ccccceeeeeeehchhhhhheeeehhhhhcccccccccccccceeeeccccccccccccccchheeecccceeeeeeeecccccccch LIVQKELDREEKDTYVMKVKVEDGGFPQRSSTAILQVSVTDTNDNHPVFKETEIEVSIPENAPVGTSVTQLHATDADIGENAKIHFSFSNLVSNIARRLF
heehhhhchccccceeeeeeeecccccccccccccceeeeeeeccccccccccccccceeehhhhhhhhhhhh HLNATTGLITTIKEPLDREETPNHKLLVLASDGGLMPARAMVLVNVTDVNDNVPSIDIRYIVNPVNDTVVLSENIPLNTKIALTTVTDKDADHNGRVTCFT
heccccceeeeeccccccccccccccceeecccccccccccceeeeeeeecccccccceeeeeeeecccccccceeeee DHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAK
cccccccccchccchhhhhhhhhhhcccccccchhhhhheeecccccccccccccccceeeeeeeeeecccccccce INYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYG
cccccccccccccccceeehccccccccccccceeecccccccccccccccccccceeecccccccccccccceeeeeeccccccc DNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIA
ccceeeeeeeccccccccccccccccccccccccccccceeecccccccceeeeeeeeecccccceeeeee VDNDTGMNAEVRYSIVGGNTRDLFAIDQETGNITLMEKCDVTDLGLHRVLVKANDLGQPDSLFSVVINLFVNESVTNATLINELVRKSTEAPVTPNTEI
ccccceeeeeeeeccccchhheeeccccccccccccchhhhhhhhhhehcccccchhhhhhhhhcccccccccceeee ecccccccccccccceeeeeeee
```

```
Alpha helix      (h) :15.73%
Extended strand  (e) :25.80%
Random coil      (c) :58.47%
```

Fig. 13E-2

```
         810        820        830        840        850        860        870        880        890        900
          |          |          |          |          |          |          |          |          |          |
ADVSSPTSDYVKILVAAVAGTITVVVIFITAVVRCRQAPHLKAAQKNKQNSEWATPNPENRQMIMKKKKKKHSPKNLLLNFVTIEETKADDVDSDG
cccccccchhhhhhhhcccceeeeeehhhhhchccccchhhhhccccccccchhhhhhhhccccceeeeeeeeecccccccccccc
NRVTLDLPIDLEEQTMGKYNWVTTPTTFKPDSPDLARHYKSASPQPAFQIQPETPLNSKHHIIQELPLDNTFVACDSISKCSSSSSDPYSVSDGYPVTT
cccceccccccccceeeccccccccccchhccccccccccceeeecccccccccccceeeccccccccccccccccee
FEVPVSVHTRPSQRRVTFHLPEGSQESSSDGGLGDHDAGSLTSTSHGLPLGYPQEEYFDRATPSNRTEGDGNSDPESTFIPGLKKAAEITVQPTVEEASD
eeeceeeeccccccccccccccccccccccccccccccccccccccccchhhccccccccccchhcccceeeeccccccccc
NCTQECLIYGHSDACWMPASLDHSSSSQAQASALCHSPPLSQASTQHHSPRVTQTIALCHSPPVTQTIALCHSPPPIQVSALHHSPPLVQATALHHSPPS
cccceeeecccccccccchhhhccccccccccccccccccccccccccccccccccccceeecccccccccccccccc
AQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRG
ccccccccchhhhhchccccchhhccccccccceeeccccccccccccccccccccccccccccccccccceeeccccccccc
DSPIMEEHPL
ccccccccc
```

Alpha helix       (h):15.73%
Extended strand   (e):25.80%
Random coil       (c):58.47%

Fig. 13F: 109P1D4 variant 6 Secondary Structure

```
          10         20         30         40         50         60         70         80         90        100
           |          |          |          |          |          |          |          |          |          |
MTVGFNSDISSVVRVNTTNCHKCLLSGTYIFAVLLVCVVFHSGAQEKNYTIREEIPENVLIGNLLKDLNLSLIPNKSLTTTMQFKLVYKTGDVPLIRIEE
ceeecccceeeeecccccccccccccccccccchhhhhhhheeeeccccccccchhhhhhhhcceeccccccccccceeeeeeecccccccceeeeec
DTGEIFTTGARIDREKLCAGIPRDEHCFYEVEVAILPDEIFRLVKIRFLIEDINDNAPLFPATVINISIPENSAINSKYTLPAAVDPDVGINGVQNYELI
ccccccccccchhhhhhhhcccccccccccceeeeehhcccccchhhhhhhhhheeeehhhhhcccccccccccccccccccccccccccchhee
KSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIG
eccccccccccccccccchheehhhhchcccccccccccceeeeeeeccccccccceeeeeeeeeeecccccccccceeeeecccccccccc
ENAKIHFSFSNLVSNIARRLFHLNATTGLIITKEPLDREETPNHKLLVLASDGGLMPARAMVLVNVTDVNDNVPSIDIRYIVNPVNDTVVLSENIPLNTK
ccceeehhhhhhhhhhheccccceeeeeeccccccceeeeccccccccceeeeeeeeeeeeeeccccccccceeeeeeeeeeecccccccee
IALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENN
eeeeeeeecccccccceeeeeeccccccccccchccchehhhhhhhcccccccccchhhhheeeeecccccccccccccceeeeeeeeecccc
SPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYV
cceeeeeeecccccccccccccceeeeeccccccccccccceeeeeeccccccceeeeeeecccceeccccceeeeeeccccccccceeee
PENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYN
ccccccccceeeeeeccccccccceeeeeeeccccccccccceeeeeecccccccceeeeeecccccccccceeecccccccccceeeeeecc
YSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNA
cceeeeecccccccceeeeeeeccccccceeeeeeeccccceeeeeeehhhhhhhhhcccccccchheeccccccccchhehhhhhhhhheccccch
TLINELVRKSIEAPVTPNTEIADVSSPTSDYVKILVAAVAGTITVVVVIFIITAVVRCRQAPHLKAAQKNMQNSEWATPNPENRQMIMKKKKKKHSPK
hhhhhhhhcccccccccccccccccccccceeeeeeehhhhhhhhcccccccceeeeeeehhhhhhhhcccccccchhhhhhhhhhcccccc
NLLINFVTIEETKADDVDSDGNRVTLDLPIDLEEQTMGKYNWVTTPTTFKPDSPDLARHYKSASPQPAFQIQPETPLNLKHHIIQELPLDNTFVACDSIS
ceeeeeecccccccccccccccccccccccccccccccccccccccccccccccccccccccccccchhcccccccccccceeeeccccccc
KCSSSSSDPYSVSDCGYPVTTFEVPVSVHTRPTDSRT
cccccccccccccccceeeeeeeeeeecccccccccc Alpha helix      (h):15.04%
                       Extended strand  (e):31.24%
                       Random coil      (c):53.71%
```

Fig. 13G: 109P1D4 variant 7 Secondary Structure

```
             10         20         30         40         50         60         70         80         90        100
              |          |          |          |          |          |          |          |          |          |
MFRVGFLIISSSSSLSPLLLVSVRVNTTNCHKCLLSGTYIFAVLLVCVVFHSGAQEKNYTIREEIPENVLIGNLLKDLNLSLIPNKSLTTTMQFKLVYK
ceeeeeeeeecccccehceeeeeeeeccccccccchhcchhhhheeeeeeccccccccceeeccchehhhhhhcceeccccccceeeeeeeec
TGDVPLIREEDTGEIFTTGARIDREKLCAGIPRDEHCFYEVEVAILPDEIFRLVKIRFLIEDINDNAPLFPATVINISIPENSAINSKYTLPAAVDPDV
ccccceeeecccccccceeecccccccchhhhhhhhhheeeehhhhhcccccccceeeeeeccccccccceeeeeeeccccccccccccc
GINGVQNYELIKSQNIFGLDVIETPEGDKMPQLIVQKELDREEKDTYMKVKVEDGGFPQRSSTAILQVSVTDTNDNHPVFKETEIEVSIPENAPVGTSV
cccccchheeeecccccccccehhhhhccccccchheehhhhcccccccceeeeeeecccccccccccceeeeeeeeecccccccccc
TQLHATDADIGENAKIHFSFSNLVSNIARRLFHLNATTGLITIKEPLDREETPNHKLLIVLASDGGLMPARAMVLVNVTDVNDNVPSIDIRYIVNPVNDTV
eeeeecccccccceehhhhhhhhhhhhhhhhhhhhheccccceeeccccccccccccceeeeeeeccccccccccceeeeeeeeccccc
VLSENIPLNTKIALITVIDKDADHNGRVTCFTDHEIPFRLRPVFSNQFLLENAAYLDYESTKEYAIKLLAADAGKPPLNQSAMLFIKVKDENDNAPVFTQ
eeeccccceeeeeeeeeccccccccceeeeeeeecccccccchhhhhhhhhcccccchhhhhhhhccccccccchhhheeeeecccccccceee
SFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSP
eeeeeeeecccccccceeeeeccccccccceeeeeeeccccccccceeeeeeecccccccceeeeeeeccccccccceeeeeeecccccc
VFTHNEYKFYVPENLPRHGTVGLITVTDPDYGDNSAVTLSILDENDDFTIDSQTGVIRPNISFDREKQESYTFYVKAEDGGRVSRSSAKVTINVVDVND
eeeccccccccccccceeeeeeeecccccccceeeeeeeeeecccceeeeecccccccceeecccccccccceeeeeecccccceeeeeeeecc
NKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIV
cccceeeeeeccccccccccceeeeeeccccccceeeeeeeeccccheeeeecccccccceeeeeecccccccccchheeecccccccchhhhhhh
NLFVNESVTNATLINELVRKSIEAPVTPNTEIADVSSPTSDYVKILVAAVAGTIIVVVVIFITAVVRCRQAPHLKAAQKNMQNSEWATPNPENRQMIMMK
hhehcccccchhhhhhhhhhccccccccccccccchhhhhhhcccceeeeeeeehhhhhhhhccceeeeeeeeehhhhhhcccccccchhhhhhh
KKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPL
hhhhhcccccceeeeeeccccccccccccceeeeccccccccccchcccceeeeecccccccccchccccccccccccccccceeeeeec
DNTFVACDSISNCSSSSSDPYSVSDCGYPVTTFEVPVSVHTRPTDSRT
cceeeeecccccccccccccccccceeeeeeeeecccccccc Alpha helix      (h):15.27%
                            Extended strand  (e):31.49%
                            Random coil      (c):53.24%
```

Fig. 13H: 109P1D4 variant 8 Secondary Structure

```
         10        20        30        40        50        60        70        80        90        100
          |         |         |         |         |         |         |         |         |         |
MFRVGFLIISSSSSLSPLLLVSVVRVNTINCHKCLLSGTYIFAVLLVCVVFHSGAQEKNYTIREEIPENVLIGNLLKDLNLSLIPNKSLTTMQFKLVYK
ceeeeeeeeecccchccheeeeeeecccccccheehhcchhhhhheeeeecccccccccheehhhhhhhcceeecccccccccceeeeeeeeeec TGDVPLIRIEEDTGEIFTTGARIDREKLCAGIPRDEHCFYEVEVAILPDEIFRLVKIRFLIEDINDNAPLFPATVINISIPENSAINSKYTLPAAVDPDV
cccceeeeeeccccccccceeecccccchhhhhhhhccccccceeecccceeeehhchhhhhheeeechhccccccceeeeccccccccccccccc GINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSV
ccccchheeecccccceeeeeeccccccccccceeeeehhhhhcccccccccceeeeehhhhhchcccccceeeeeeccccceeeeeeccccccccce TQLHATDADIGENAKIHFSFSNLVSNIARRLFHLNATTGLITIKEPLDREETPNHKLLVLASDGGLMPARAMVLVNVTDVNDNVPSIDIRYIVNPVNDTV
eeeeccccccccceeeehhhhhhhhhhhhheccccceeeeeccccccccccccccceeeeeeccccccceeeeeeecccccceeeeeeccccccce VLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQ
eeeccccccccccccccceeeeeeeeccccccchhhhhhhhccccccceeeeccchhhhhhhhhhcccccccccchhheeecccccccccceeeee SFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSP
eeeeeeccccccccceeeeeeeccccccccceeeeeeccccccccccccceeeeeeeeeccccccceeeeeeccccccceeeeeeeeeccccc VFTHNEYKFYVPENLPRHGTVGLITVTDPDYGDNSAVTLSILDENDDFTIDSQTGVIRPNISFDREKQESYTFYVKAEDGGRVSRSSSAKVTINVVDVND
eeeeccccccceecccceeeeeeeeecccccccceeeeeeeccccccceeeccccceeeecccccccceeeeeeccccccceeeeeeeeeccc NKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIV
ccccceecccceeeeeeeeecccceeeeeeeeecccccceeeeeeeeeccchheeeeccccccccchheheccccccccchhhhhhh
```

Alpha helix    (h):14.40%
Extended strand (e):27.61%
Random coil    (c):57.99%

Fig. 13H-2

```
         810        820        830        840        850        860        870        880        890        900
          -          -          -          -          -          -          -          -          -          -
NLFVNESVTNATLINELVRKSIEAPVTPNTEIADVSSPTSDYVKILVAAVAGTITVVVIFITAVVRCRQAPHLKAAQKNMQNSEWATPNPENRQMIMMK
hhehccccchhhhhhhhhhccccccccccccccccchhhhhhhhhhhccceeeeeeeeeehhhhhhhhccccchhhhhhhhhccccccccchhhhhhh
KKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPL
hhhhhcccccccccceeeeeeeeccccccccccccccccccccccccccccccccccchhcccccccccchhcccccccccccccceeeeccccccc
DNTFVACDSISNCSSSSSDPYSVSDCGYPVTTFEVPVSVHTRPSQRRVTFHLPEGSQESSSDGGLGDHDAGSLITSTSHGLPLGYPQEEYFDRATPSNRTE
cceeeeccccccccccccccccccccccccccccceeeeeecccccccccccccccccccccccccccccccccccccccccchhcccccccccccc
GDGNSDPESTFIPGLKKEITVQPTVEEASDNCTQECLIYGHSDACWMPASLDHSSSSQAQASALCHSPPLSQASTQHHSPPVTQTIVLCHSPPVTQTIAL
ccccccccccccccccccccceeeccccccccccccceeeeeccccccccccccccchhhhhhhhcccccccccccccccccccccccccceeeeee
CHSPPPIQVSALHHSPPLVQGTALHHSPPSAQASALCYSPPLAQAAAISHSSSLPQVIALHRSQAQSSVSLQQGWVQGANGLCSVDQGVQGSATSQFYTM
ccccccccceeeccccccccccccccccccccccccccccccchhhhhhhhccccchhhhhhhhhccccccceeeecccccccccccccchhhhhh
SERLHPSDDSIKVIPLTTFAPRQQARPSRGDSPIMETHPL
ccccccccccceeeeeccccccccccccccccccccccccc
```

```
Alpha helix      (h):14.40%
Extended strand  (e):27.61%
Random coil      (c):57.99%
```

Fig. 13I: 109P1D4 variant 9 Secondary Structure

```
          10         20         30         40         50         60         70         80         90        100
          |          |          |          |          |          |          |          |          |          |
MTVGFNSDISSVVRVNTTNCHKCLLSGTYIFAVLLVCVFHSGAQEKNYTIREEIPENVLIGNLLKDLNLSLIPNKSLTTMQFKLVYKTGDVPLIRIEE
ceeecccccceeeeccccccccccceeeehcchhhhhheeeecccccccchehhhhhcceeeeccccchhhhhhhhhcccccccceeeeecccccc DTGEIFTTGARIDREKLCAGIPRDEHCFYEVEVAILPDEIFRLVKIRFLIEDINDNAPLFPATVINISIPENSAINSKYTLPAAVDPDVGINGVQNYELI
ccccceeeecchhhhhcccccccccceeeeeeeechhhhhheeeeehhchhhhhhheeeeehccccccccccccccccccccccccccccchheee KSQNIFGLDVIETPEGDKMPQLIVQKELDREEKDTYVMKVVEDGGFPQRSSTAILQVSVTDNDNHPVFKETEIEVSIPENAPVGTSVTQLHATDADIG
ecccceeeeeccccccccccheeehhhhhccccceeeeeeccccccccceeeeeeeecccccccccceeeecccccccccccccceeeeccccccc ENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTK
cccceeehhhhhhhhhhhheccccceeecccccccceeeeeeeeeccccccccceeeeeeeeecccccccceeeeeeeccccccccceeeccccee IALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENN
eeeeeeeccccccccceeeeeeecccccccccccccchhcchhhhhhhhhhhcccchhhhhhhcccccccchhhheeeeccccccccceeeeeccc SPGIQLMKVSATADSGPNAEINYLLGPDAPPEFSLDRRTGMLTVKKLDREKEDKYLFTILAKDNGVPPLTSNVTVFVSIIDQNDNSPVFTHNEYKFYV
cccccceeeccccccccceeeeecccccccccccccccceeeeeeeeeccccceeeeeeccchhhhhhccccccccceeeeeeeeeccccccceee PENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYN
cccccccccceeeeeeccccccccceeeecccccccccccccccceeeeeeeccccccceeeeeccccccccccceeeeeeeecccccceeeecccc YSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNA
cceeeeeccccceeeeeeeeeeeeccccceeeeeeeeeeccccchhhhhhcccccchheeeecccccccchhhhhhhhheheccccccch TLINELVRKSIEAPVTPNTEIADVSSPTSDYVKILVAAVAGTITVVVVIFITAVVRCRQAPHLKAAQKNMQNSEWATPNPENRQMIMMKKKKKHSPK
hhhhhhhhhccccccccccceeeeeeehhhhhhhhhhcccceeeeeeeeehhhhhhcccceeehhhhhhcccccccchhhhhhhhhhhcccccc NLLLNVVTIEETKADDVSDSDGNRVTLDLPIDLEEQTMGKYNWVTTPTTFKPDSPDLARHYKSASPQPAFQIQPETPLNLKHHIIQELPLDNTFVACDSIS
ceeeeeeecccccccccccccccccccccccccchhccccccccccccccccccccccccccccccccccccccccccccccccccccccceeeeccccc NCSSSSSDPYSVSDCGYPVTTFEVPVSHTRPTDSRT          Alpha helix      (h) :15.04%
cccccccccccccccccceeeeeecceeecccccc           Extended strand  (e) :31.24%
                                              Random coil      (c) :53.71%
```

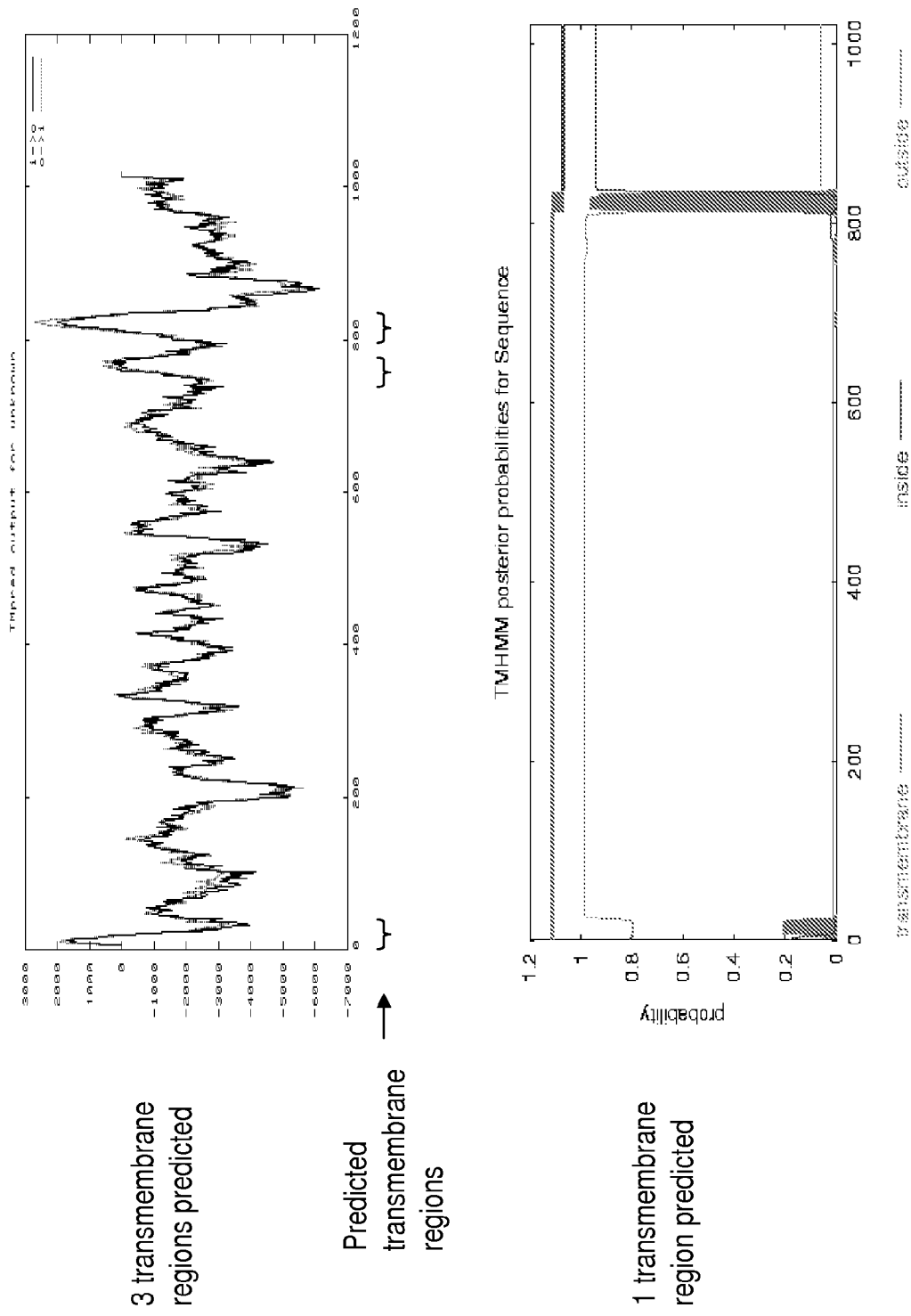
Fig. 13J: Transmembrane prediction for 109P1D4 variant 1

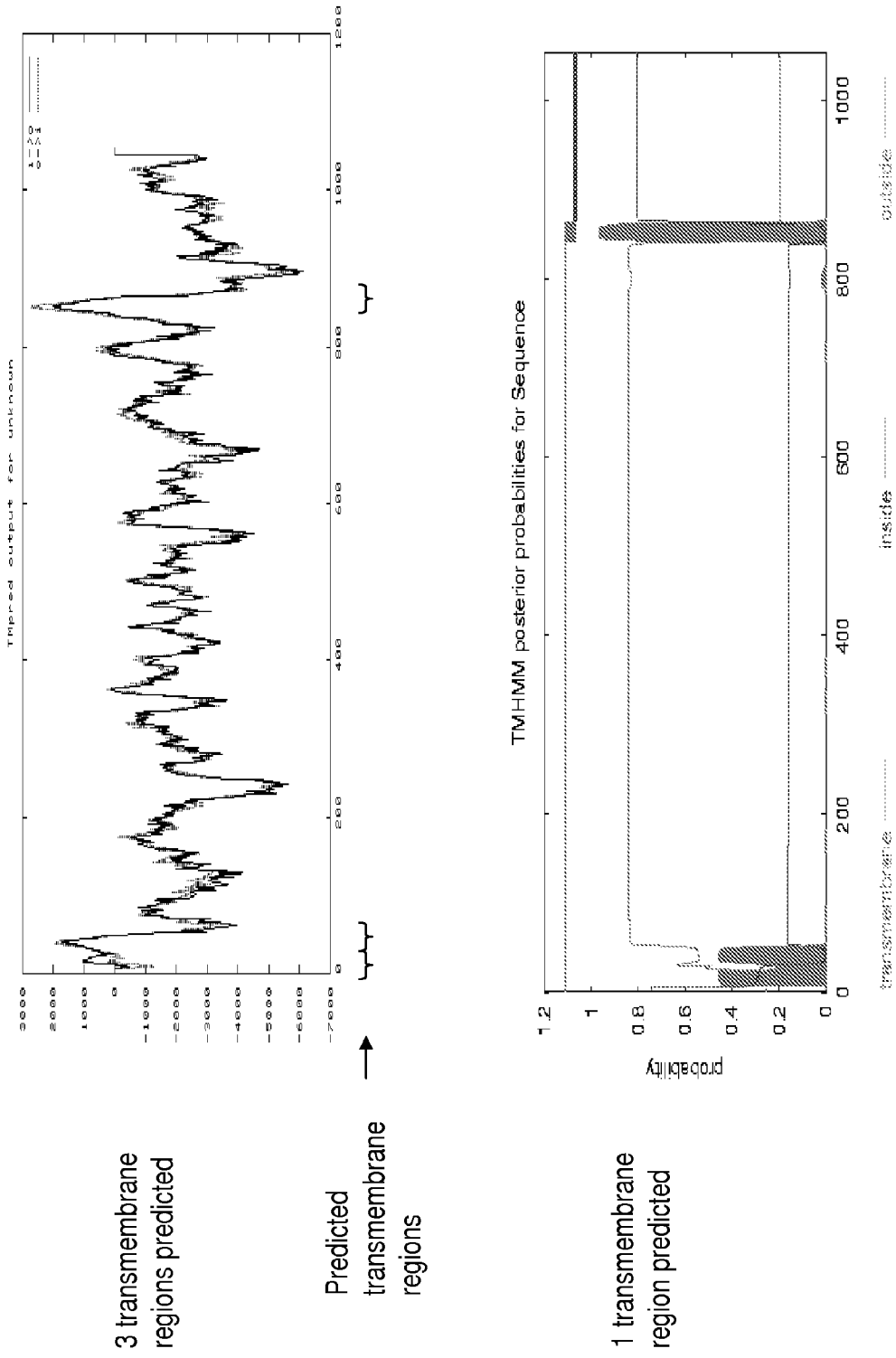
Fig. 13K: Transmembrane prediction for 109P1D4 variant 2

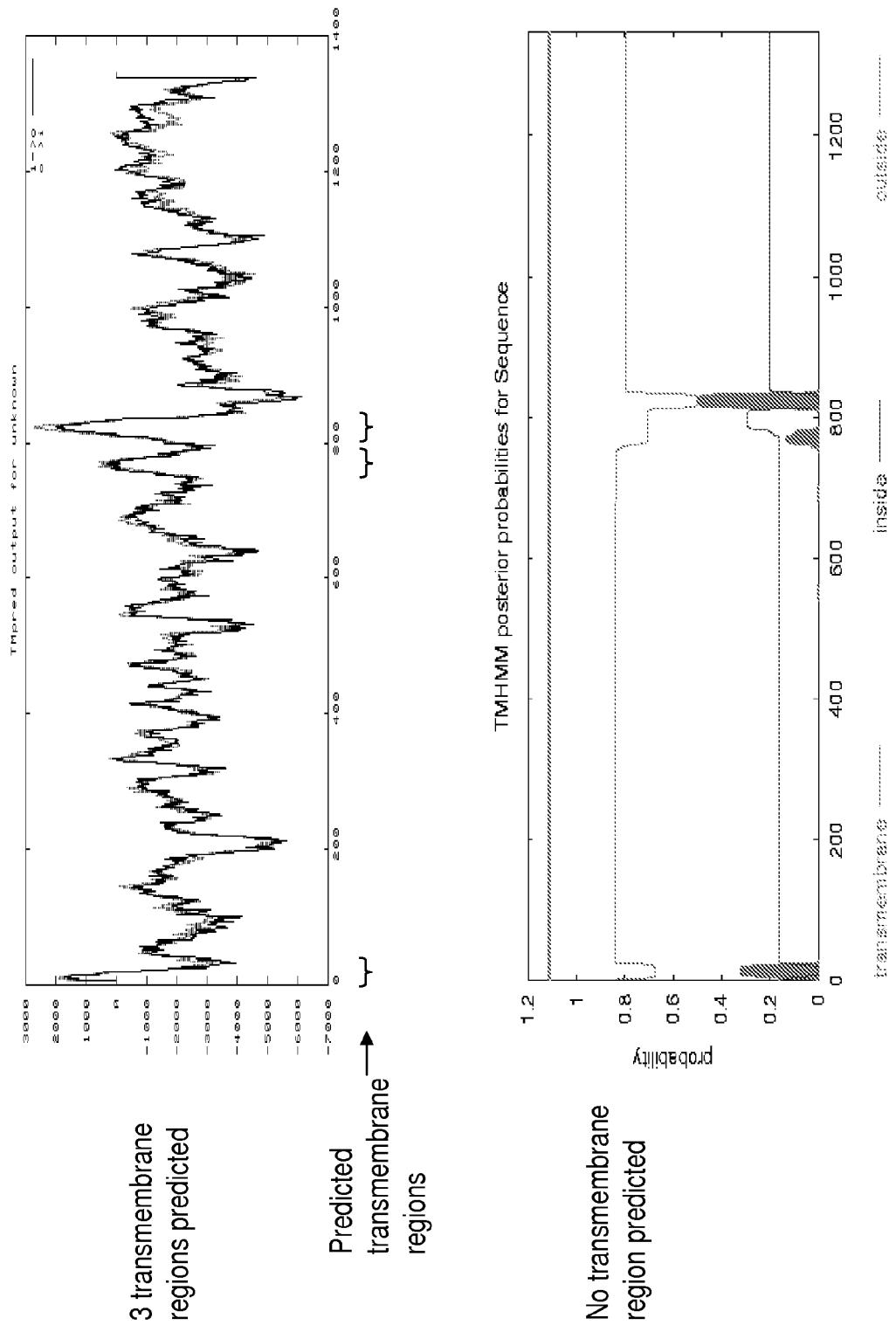
Fig. 13L: Transmembrane prediction for 109P1D4 variant 3

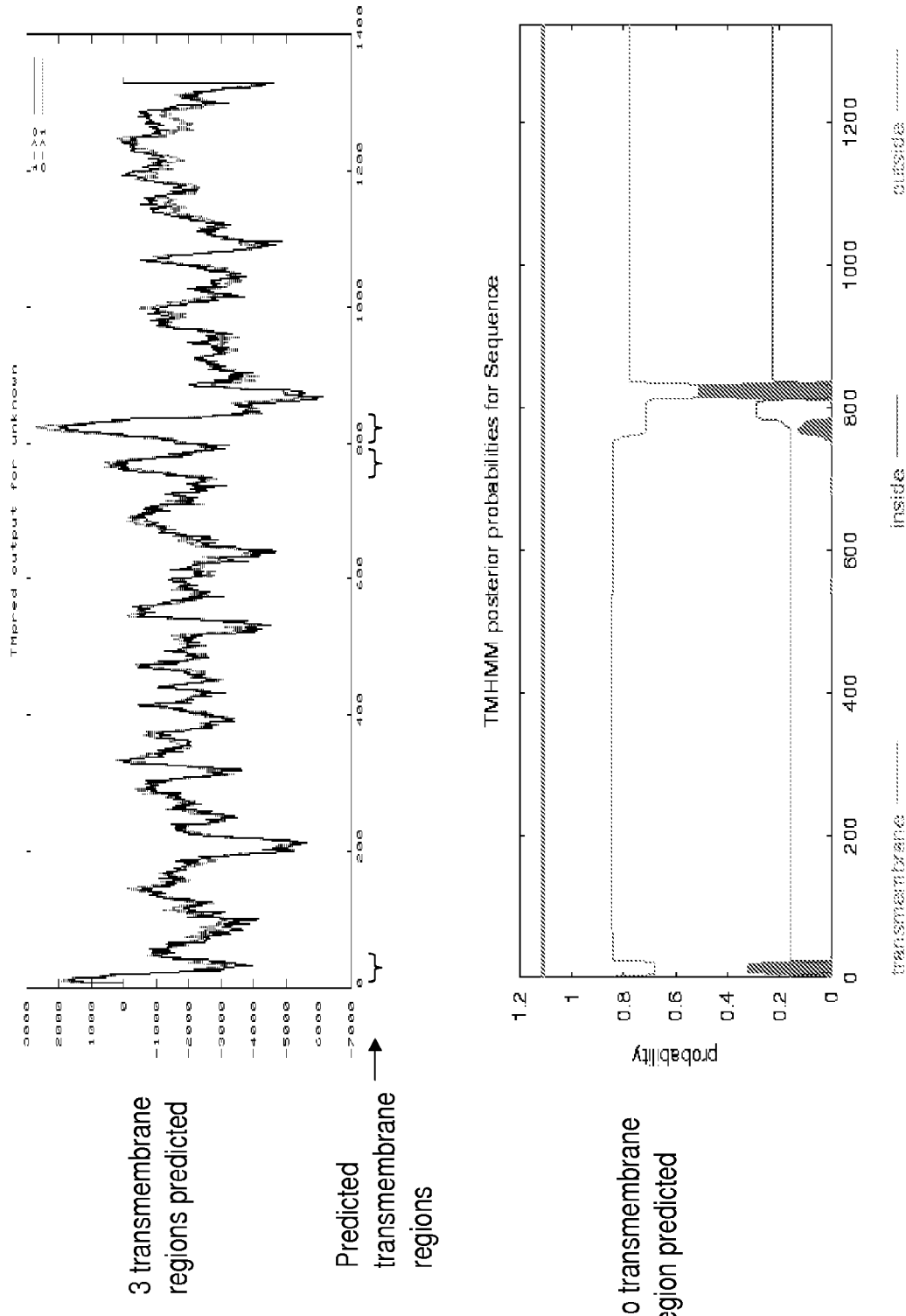
Fig. 13M: Transmembrane prediction for 109P1D4 variant 4

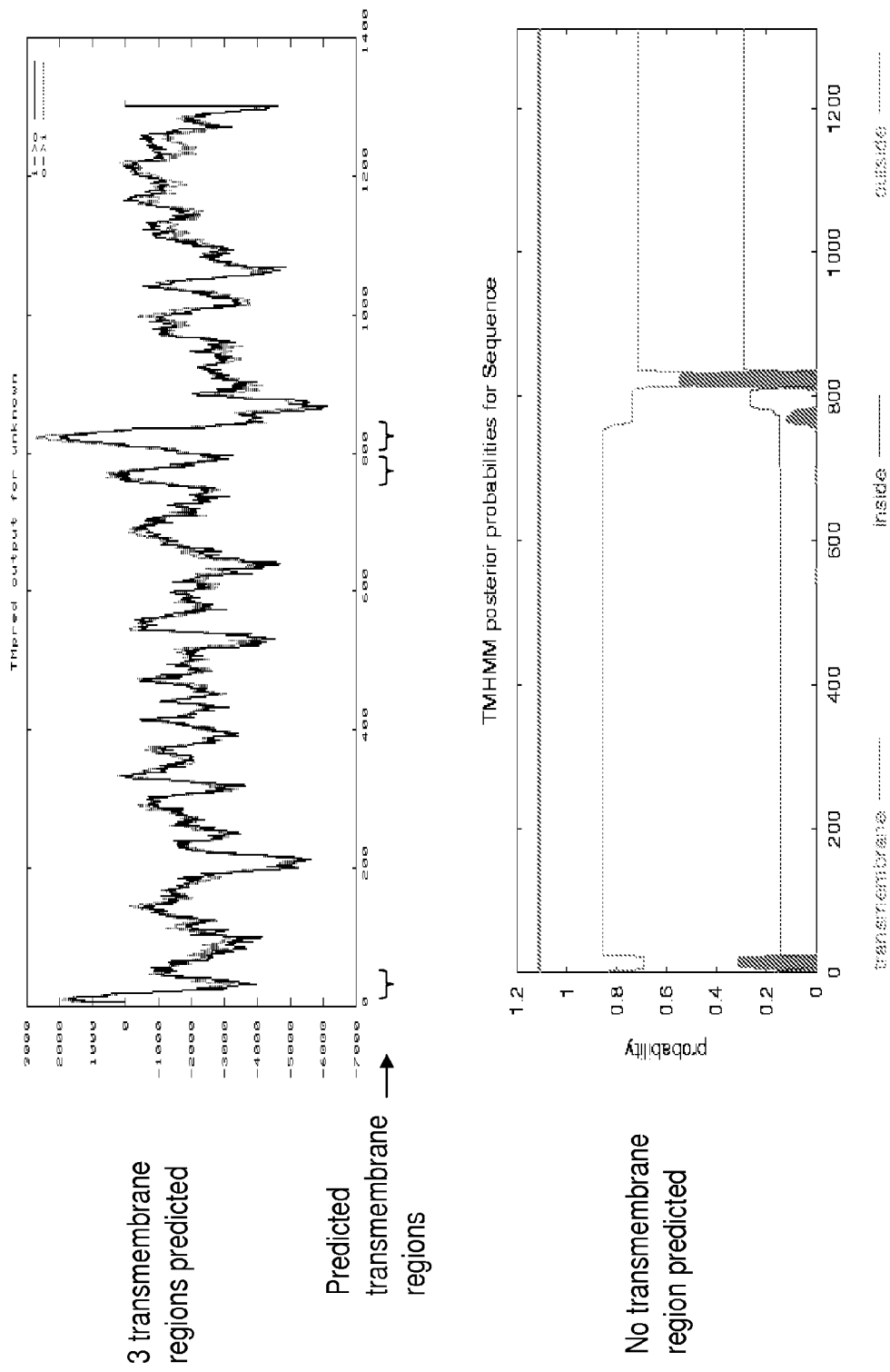
Fig. 13N: Transmembrane prediction for 109P1D4 variant 5

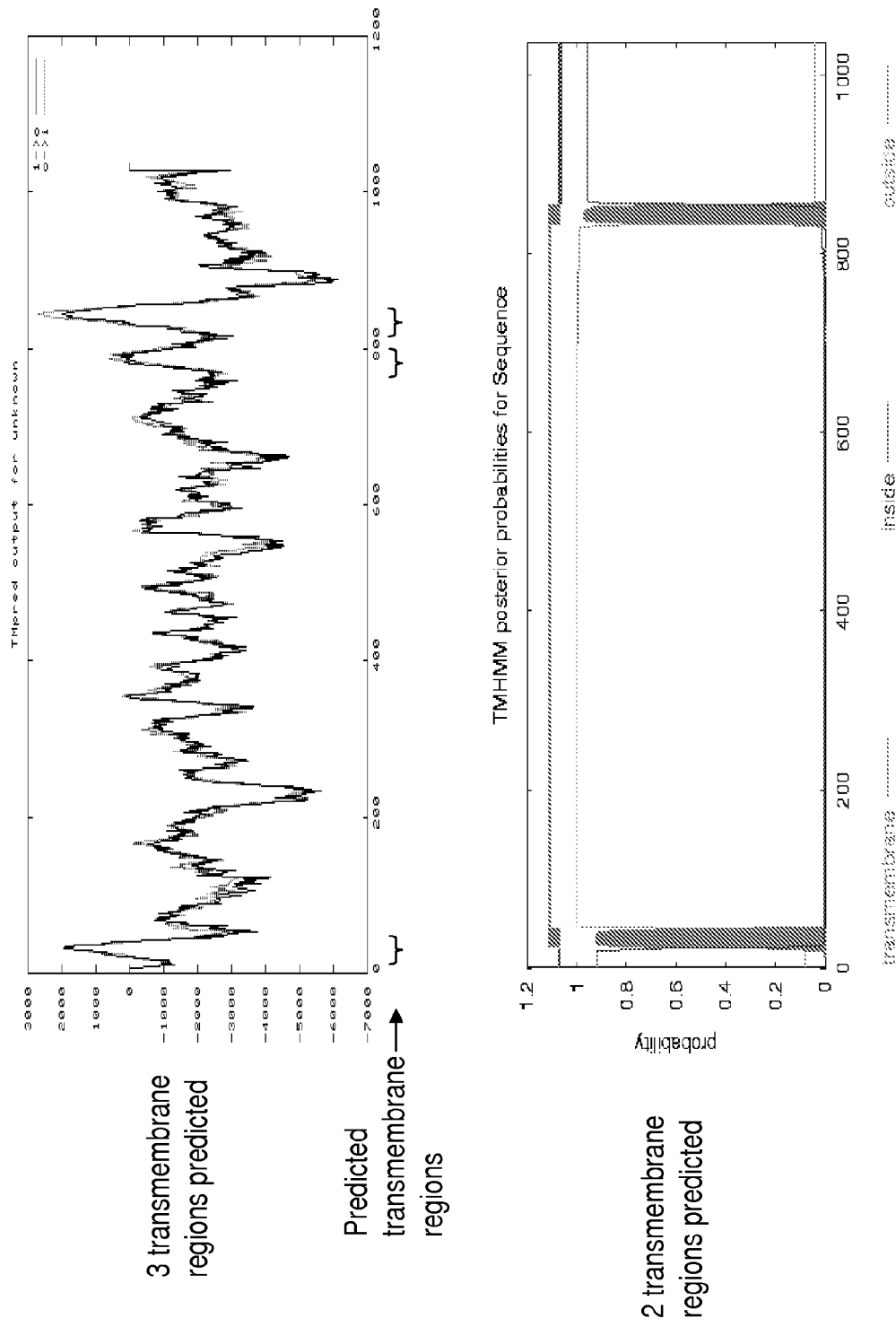
Fig. 13O: Transmembrane prediction for 109P1D4 variant 6

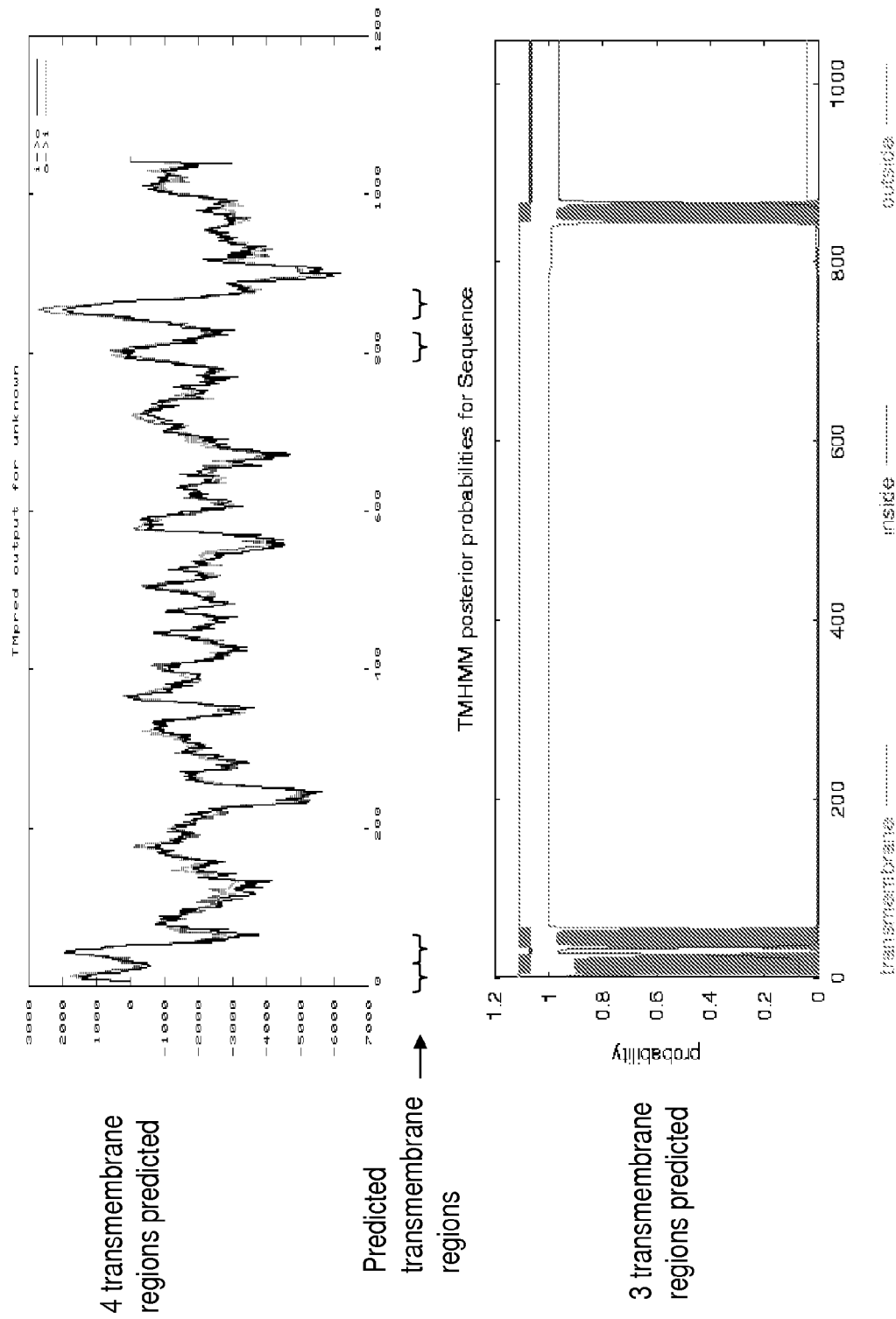
Fig. 13P: Transmembrane prediction for 109P1D4 variant 7

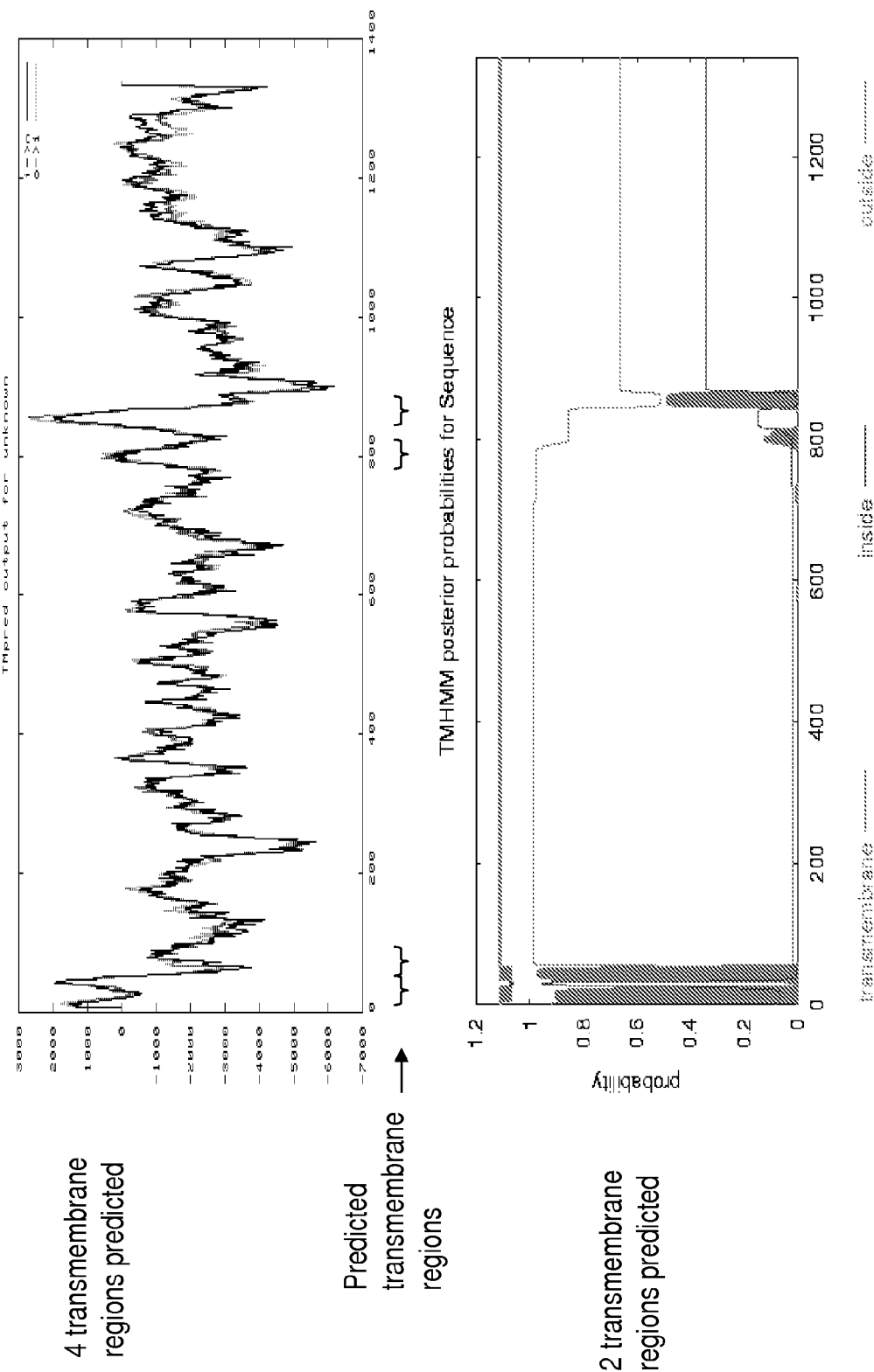
Fig. 13Q: Transmembrane prediction for 109P1D4 variant 8

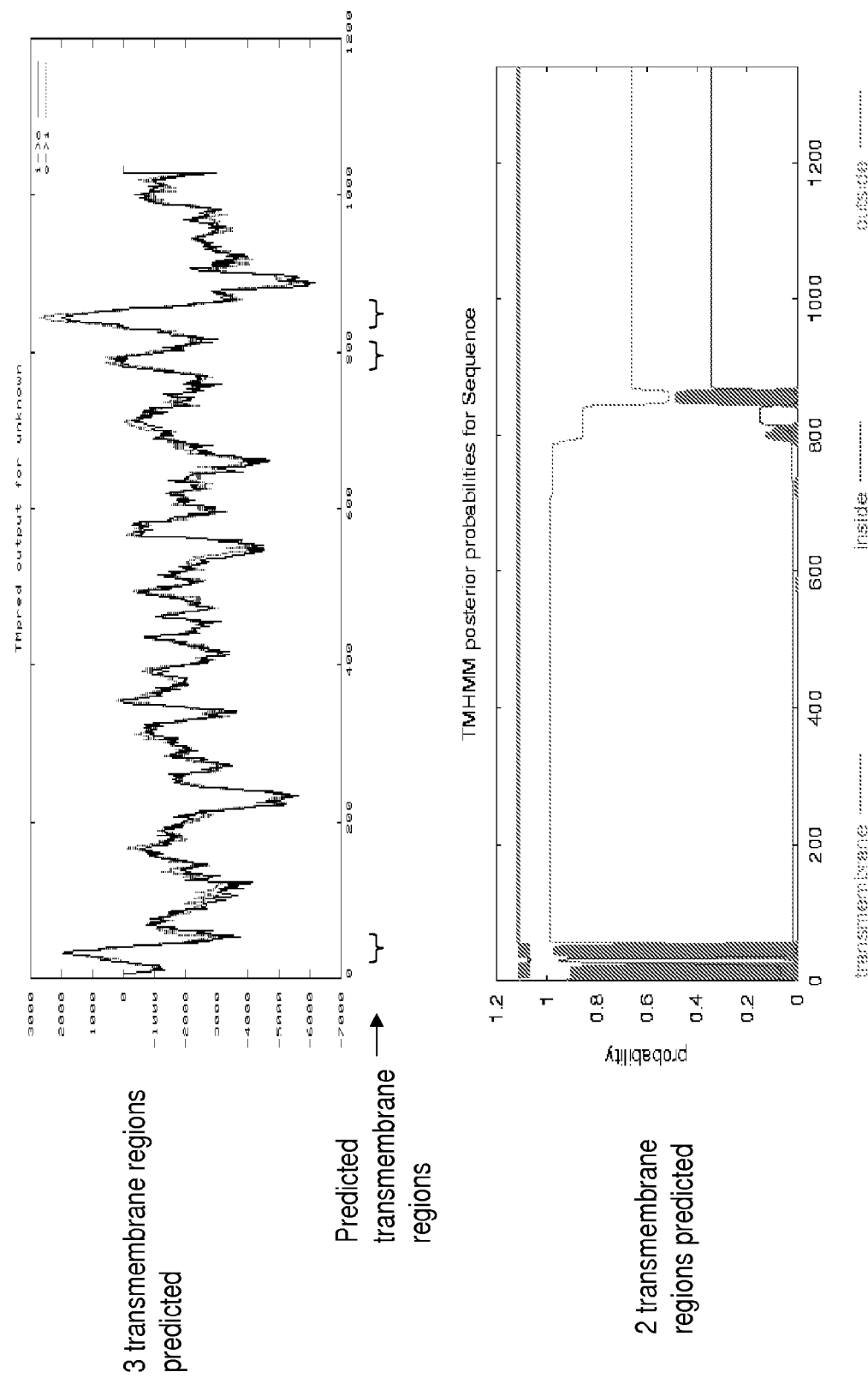
Fig. 13R: Transmembrane prediction for 109P1D4 variant 9

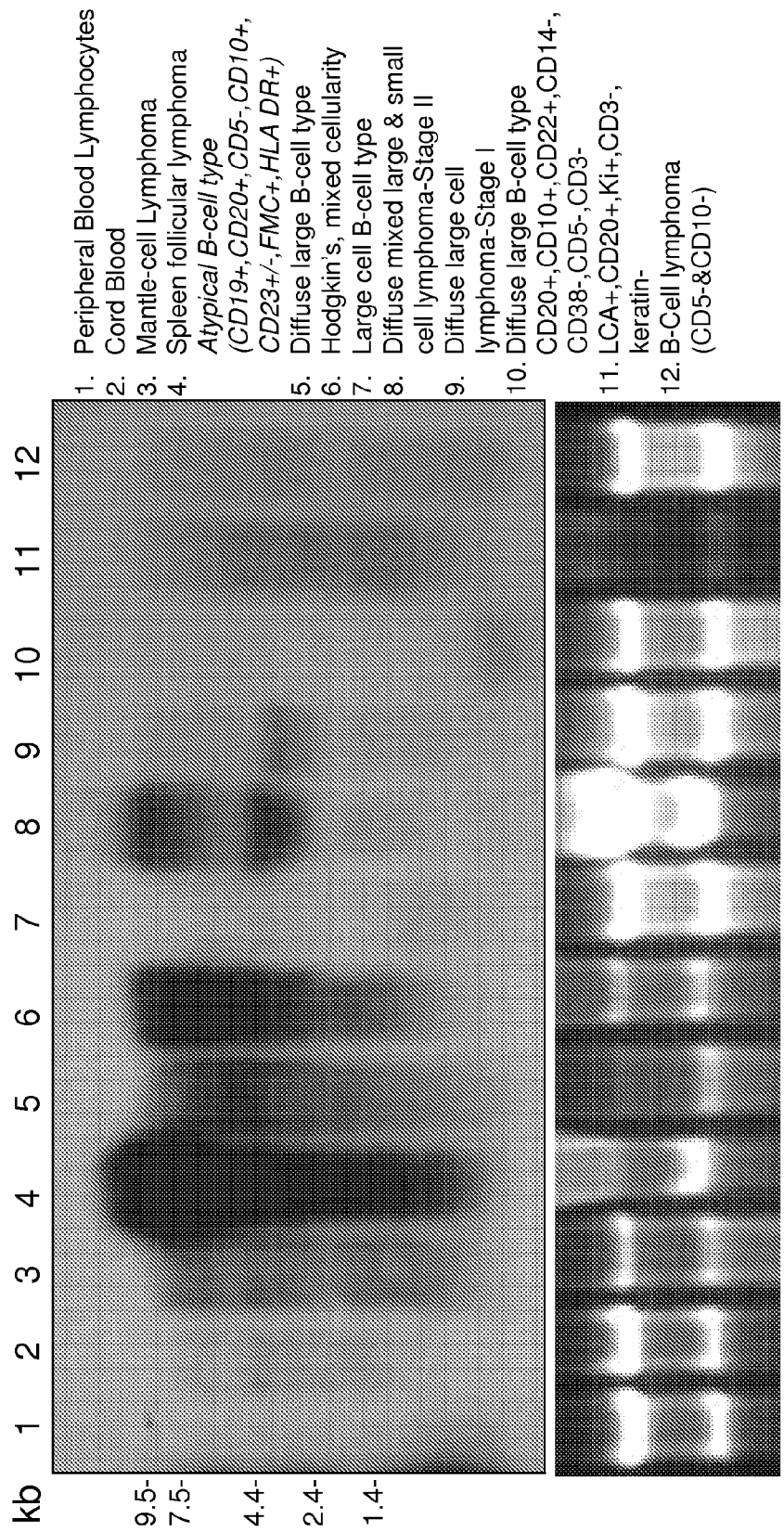
Figure 14: 109P1D4 Expression in Patient Lymphoma Specimens

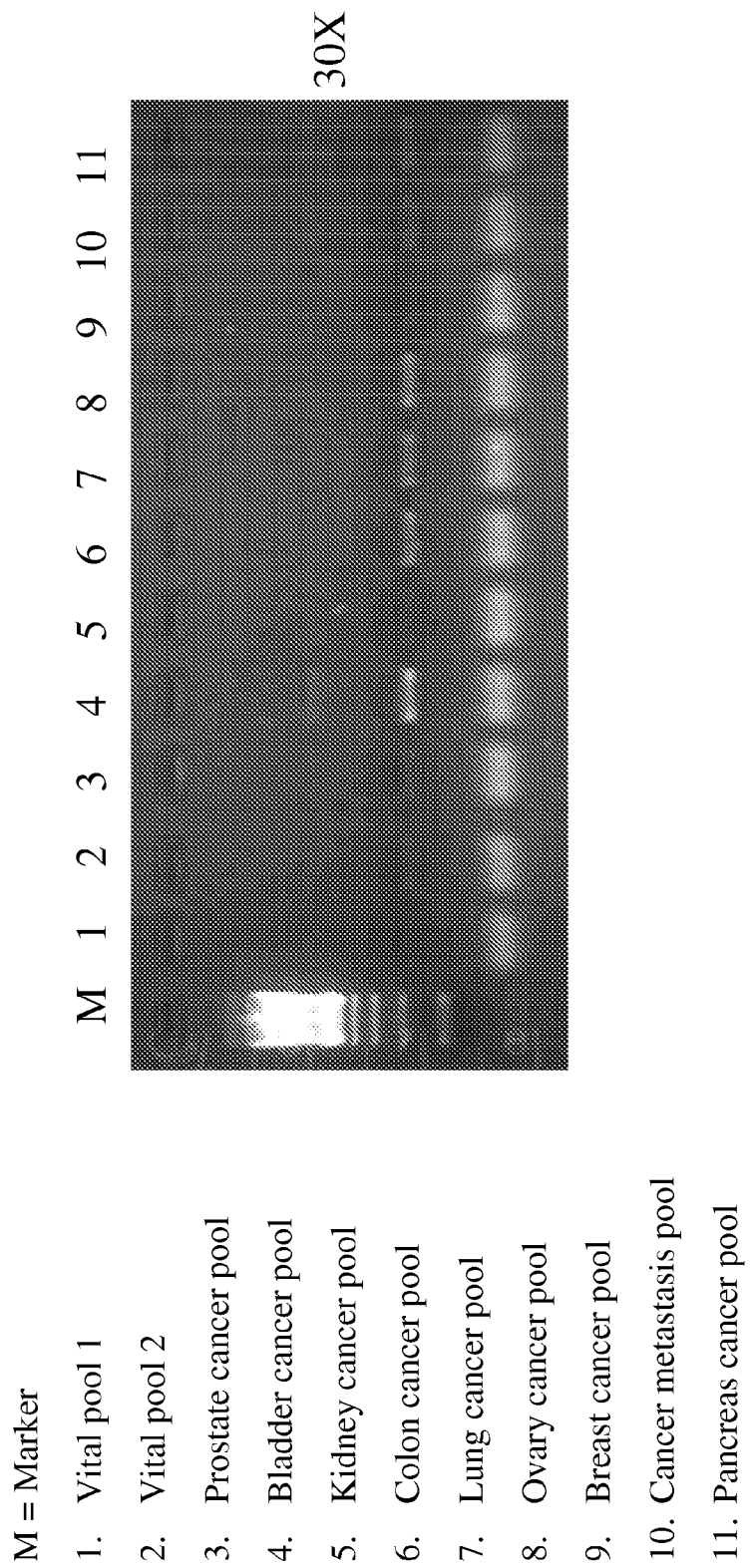
Figure 15: Expression of 109P1D4 by RT-PCR
M = Marker
1. Vital pool 1
2. Vital pool 2
3. Prostate cancer pool
4. Bladder cancer pool
5. Kidney cancer pool
6. Colon cancer pool
7. Lung cancer pool
8. Ovary cancer pool
9. Breast cancer pool
10. Cancer metastasis pool
11. Pancreas cancer pool

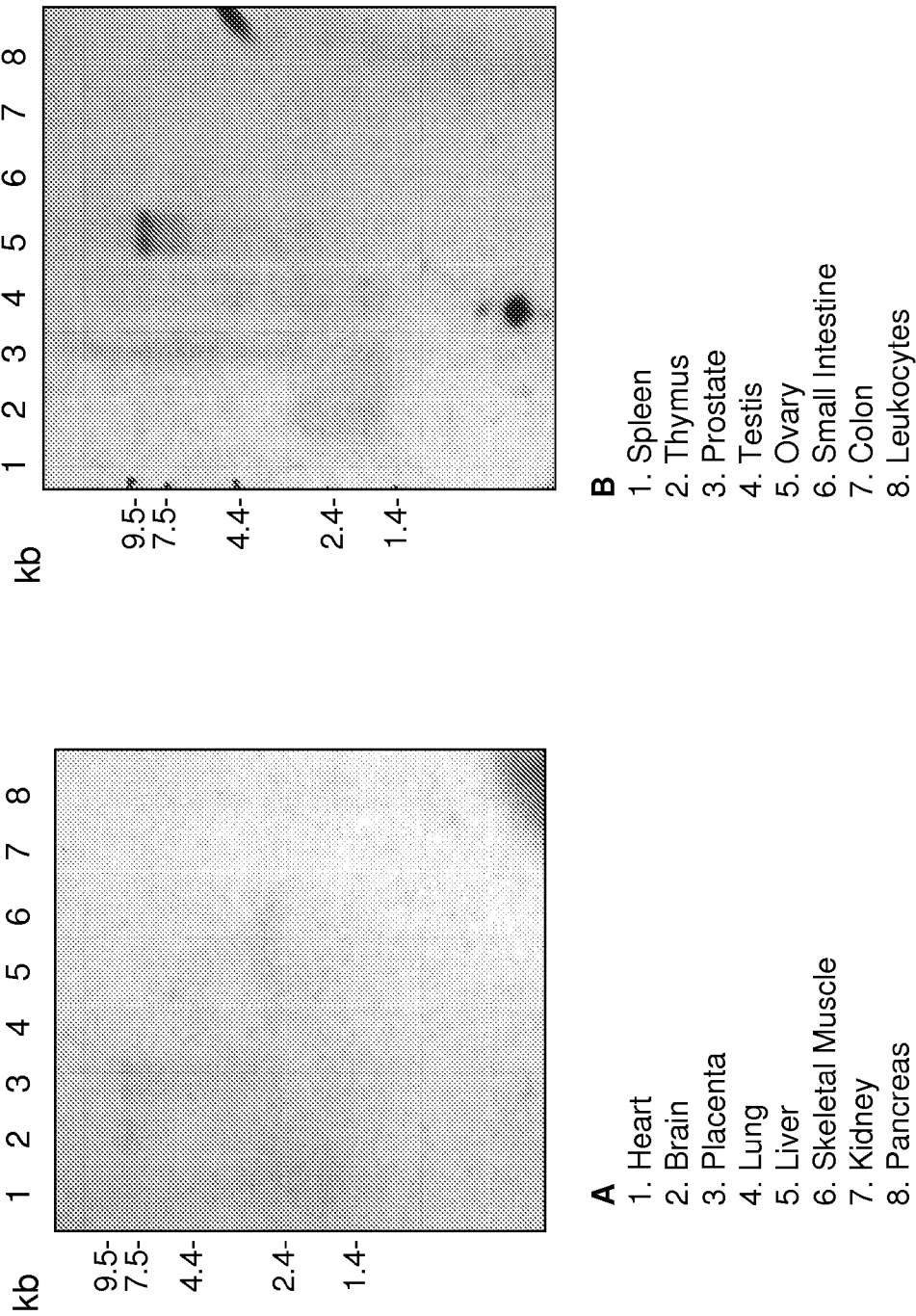
Figure 16: Expression of 109P1D4 in Normal Tissues by Northern Blot
A
1. Heart
2. Brain
3. Placenta
4. Lung
5. Liver
6. Skeletal Muscle
7. Kidney
8. Pancreas
B
1. Spleen
2. Thymus
3. Prostate
4. Testis
5. Ovary
6. Small Intestine
7. Colon
8. Leukocytes

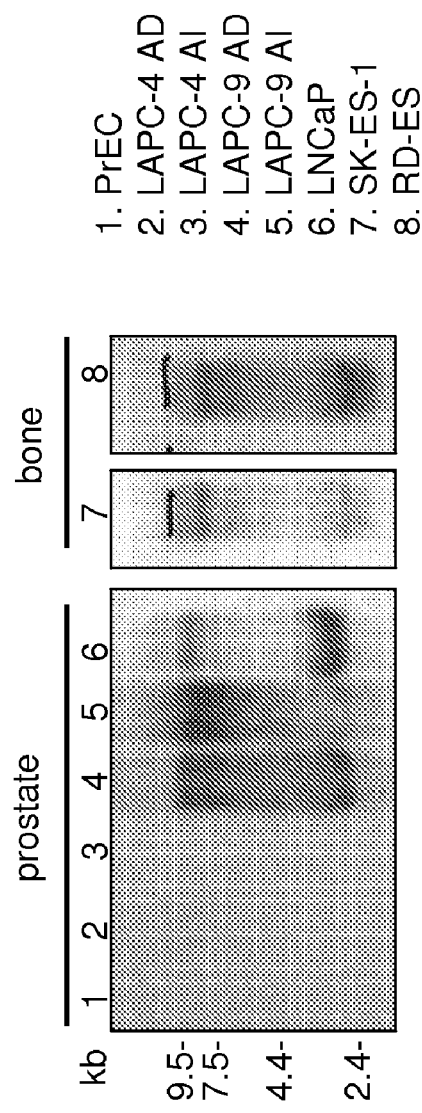
Figure 17: Expression of 109P1D4 in prostate and bone cancer cell lines

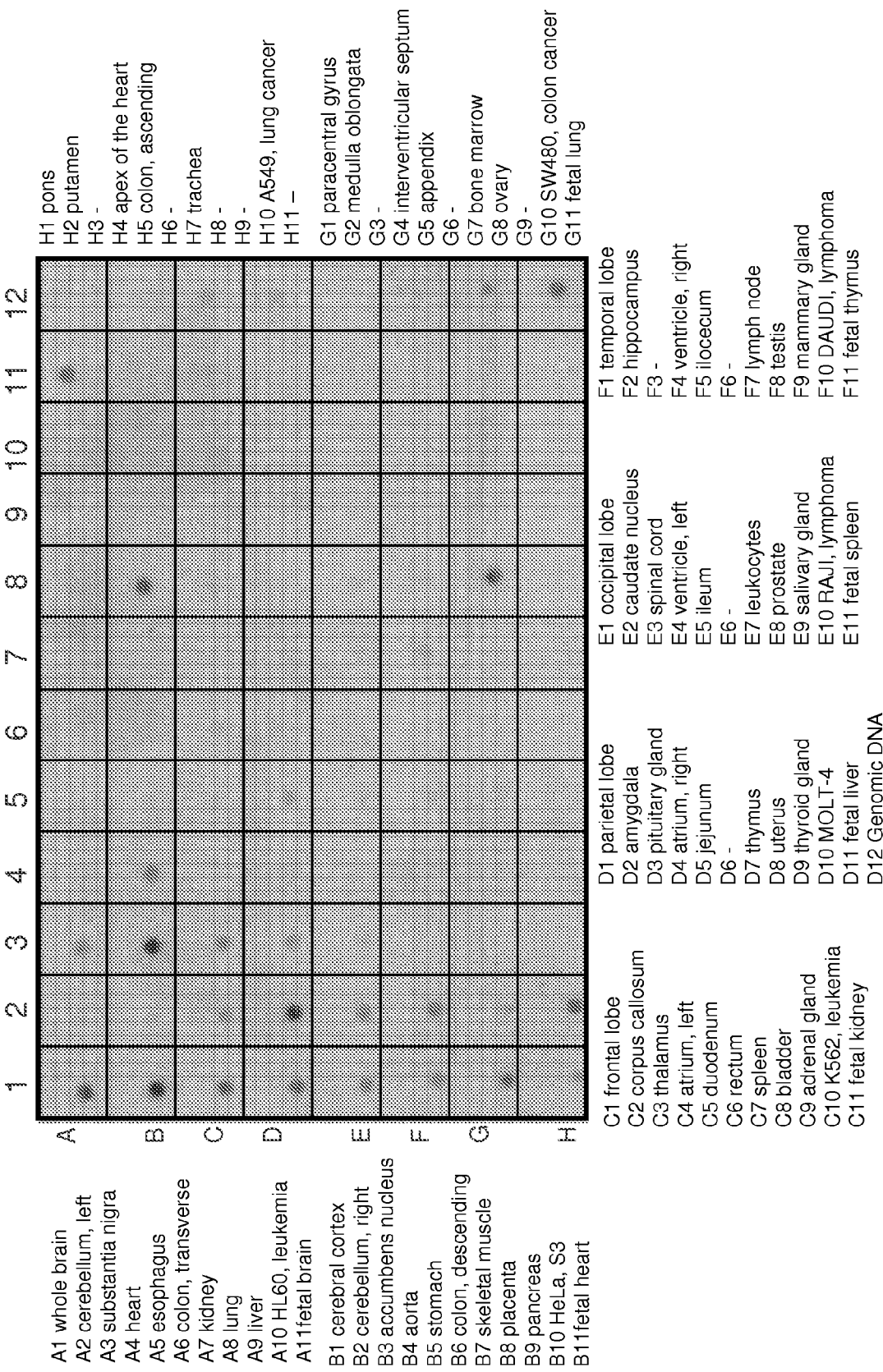
Figure 18A: 109P1D4 Expression in Human Normal Tissues

Figure 18B: Expression of 109P1D4 in Human Patient Cancer Specimens
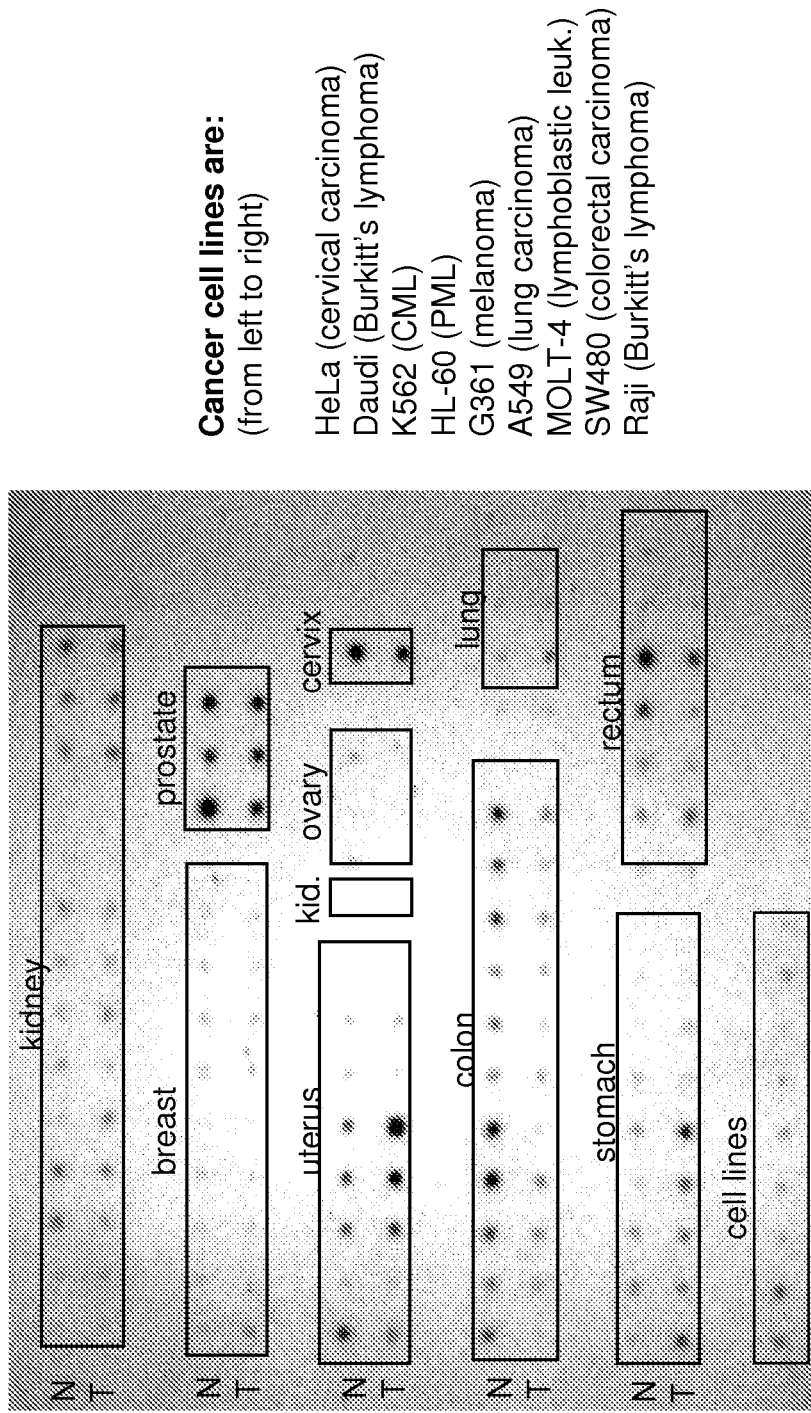

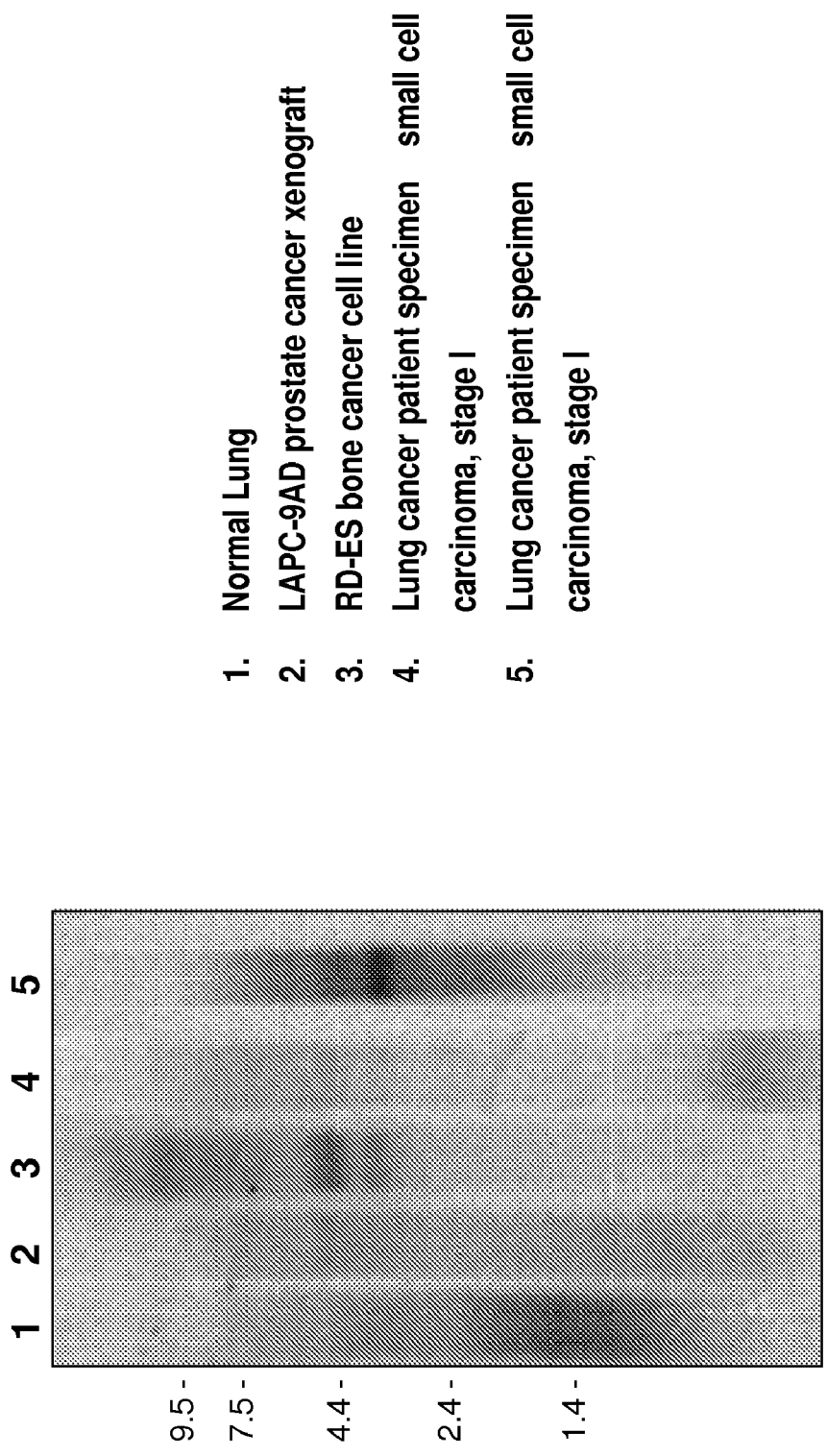
Figure 19: 109P1D4 Expression in Lung Cancer Patient Specimens
1. Normal Lung
2. LAPC-9AD prostate cancer xenograft
3. RD-ES bone cancer cell line
4. Lung cancer patient specimen — small cell carcinoma, stage I
5. Lung cancer patient specimen — small cell carcinoma, stage I

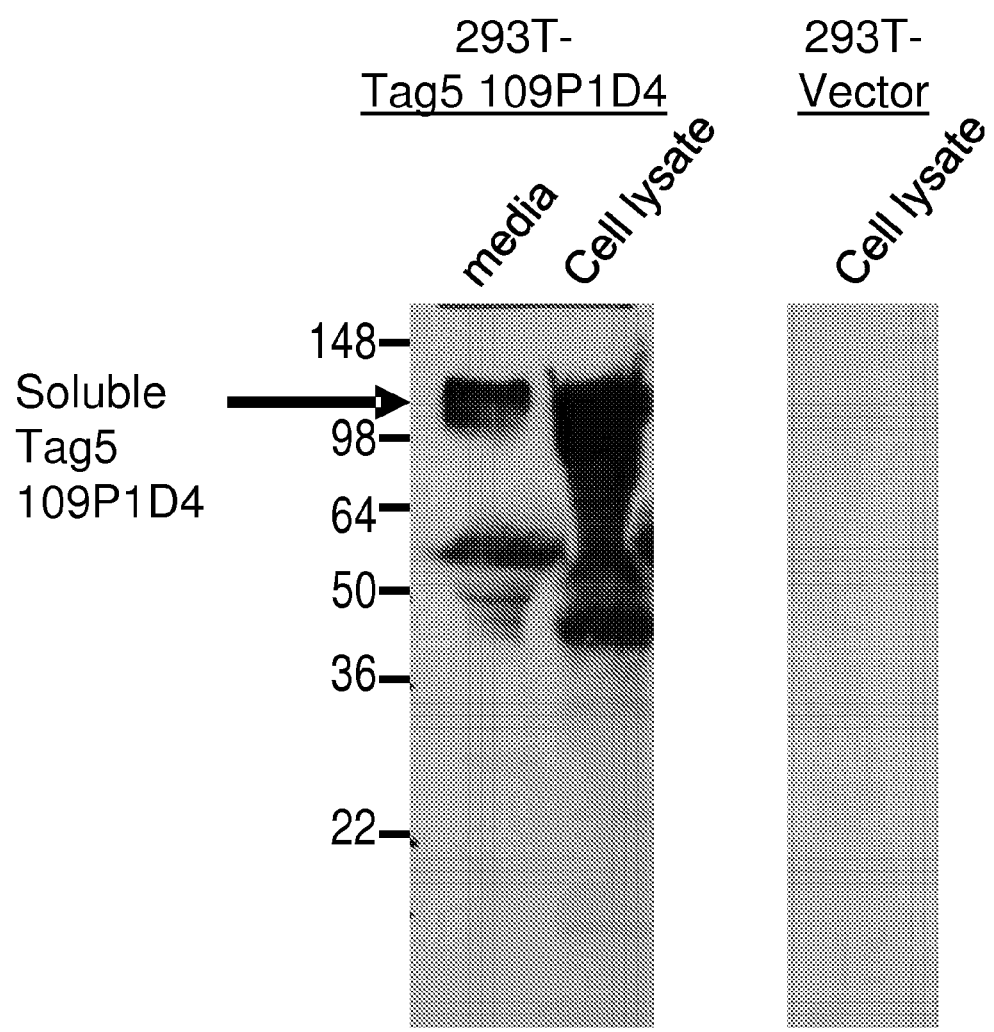
Figure 20: Expression of soluble secreted Tag5 109P1D4 in 293T cells

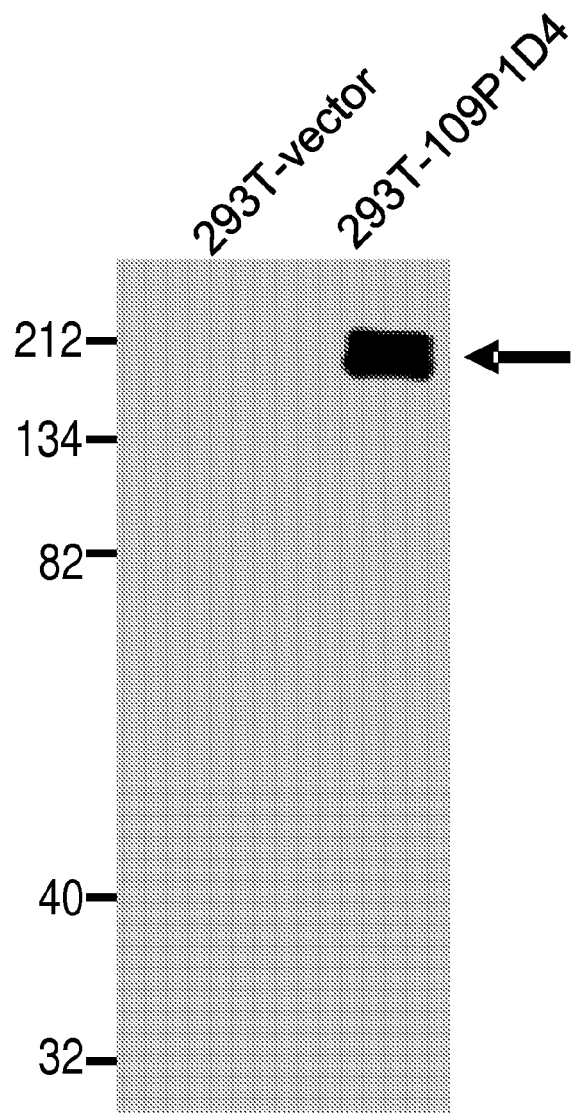
Figure 21: Expression of 109P1D4 protein in 293T cells

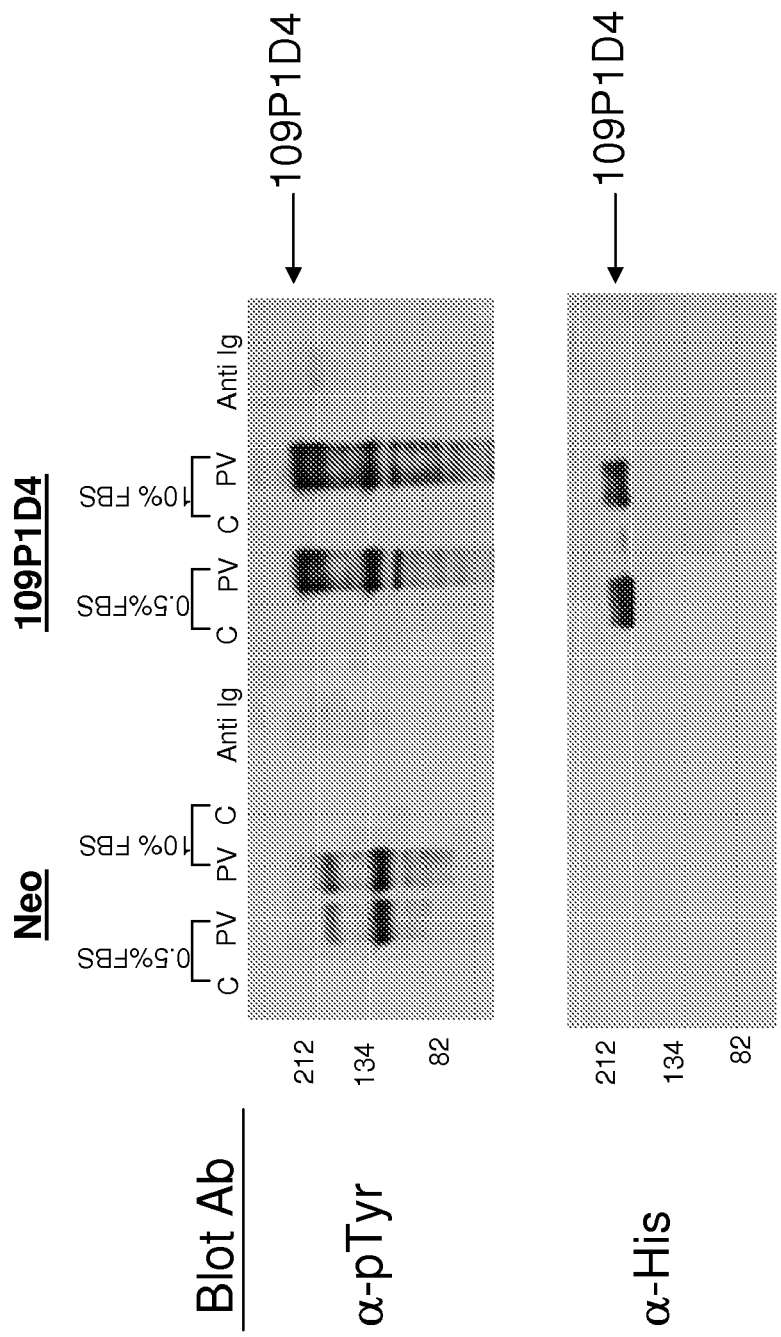
Figure 22: Tyrosine phosphorylation of 109P1D4 after pervanadate treatment

METHODS TO INHIBIT CELL GROWTH

CROSS-REFERENCE TO RELATED APPLICATIONS

This application is a continuation-in-part of pending U.S. utility patent application Ser. No. 10/121,024, filed 10 Apr. 2002 and claims priority from U.S. provisional patent application U.S. Ser. No. 60/467,002, filed 30 Apr. 2003. This application is also related to U.S. Provisional Patent Application No. 60/282,739, filed 10 Apr. 2001. The contents of the applications listed in this paragraph are fully incorporated by reference herein.

STATEMENT OF RIGHTS TO INVENTIONS MADE UNDER FEDERALLY SPONSORED RESEARCH

Not applicable.

FIELD OF THE INVENTION

The invention described herein relates to genes and their encoded proteins, termed 109P1D4 and variants thereof, expressed in certain cancers, and to diagnostic and therapeutic methods and compositions useful in the management of cancers that express 109P1D4.

BACKGROUND OF THE INVENTION

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep. 2 (9): 1445-51), STEAP (Hubert, et al., Proc Natl Acad Sci USA. 1999 Dec. 7; 96(25): 14523-8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy.

Renal cell carcinoma (RCC) accounts for approximately 3 percent of adult malignancies. Once adenomas reach a diameter of 2 to 3 cm, malignant potential exists. In the adult, the two principal malignant renal tumors are renal cell adenocarcinoma and transitional cell carcinoma of the renal pelvis or ureter. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades, Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and eight per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992-1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992-1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer. Breast cancer ranks second among cancer deaths in women. According to the most recent data, mortality rates declined significantly during 1992-1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy. Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992-1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

SUMMARY OF THE INVENTION

The present invention relates to a gene, designated 109P1D4, that has now been found to be over-expressed in the cancer(s) listed in Table I. Northern blot expression analysis of 109P1D4 gene expression in normal tissues shows a restricted expression pattern in adult tissues. The nucleotide (FIG. 2) and amino acid (FIG. 2, and FIG. 3) sequences of 109P1D4 are provided. The tissue-related profile of 109P1D4 in normal adult tissues, combined with the over-expression observed in the tissues listed in Table I, shows that 109P1D4 is aberrantly over-expressed in at least some cancers, and thus serves as a useful diagnostic, prophylactic, prognostic, and/or therapeutic target for cancers of the tissue(s) such as those listed in Table I.

The invention provides polynucleotides corresponding or complementary to all or part of the 109P1D4 genes, mRNAs, and/or coding sequences, preferably in isolated form, including polynucleotides encoding 109P1D4-related proteins and fragments of 4, 5, 6, 7, 8, 9, 10, 11, 12, 13, 14, 15, 16, 17, 18, 19, 20, 21, 22, 23, 24, 25, or more than 25 contiguous amino acids; at least 30, 35, 40, 45, 50, 55, 60, 65, 70, 80, 85, 90, 95, 100 or more than 100 contiguous amino acids of a 109P1D4-related protein, as well as the peptides/proteins themselves; DNA, RNA, DNA/RNA hybrids, and related molecules, polynucleotides or oligonucleotides complementary or having at least a 90% homology to the 109P1D4 genes or mRNA sequences or parts thereof, and polynucleotides or oligonucleotides that hybridize to the 109P1D4 genes, mRNAs, or to 109P1D4-encoding polynucleotides. Also provided are means for isolating cDNAs and the genes encoding 109P1D4. Recombinant DNA molecules containing 109P1D4 polynucleotides, cells transformed or transduced with such molecules, and host-vector systems for the expression of 109P1D4 gene products are also provided. The invention further provides antibodies that bind to 109P1D4 proteins and polypeptide fragments thereof, including polyclonal and monoclonal antibodies, murine and other mammalian antibodies, chimeric antibodies, humanized and fully human antibodies, and antibodies labeled with a detectable marker or therapeutic agent. In certain embodiments, there is a proviso that the entire nucleic acid sequence of FIG. 2 is not encoded and/or the entire amino acid sequence of FIG. 2 is not prepared. In certain embodiments, the entire nucleic acid sequence of FIG. 2 is encoded and/or the entire amino acid sequence of FIG. 2 is prepared, either of which are in respective human unit dose forms.

The invention further provides methods for detecting the presence and status of 109P1D4 polynucleotides and proteins in various biological samples, as well as methods for identifying cells that express 109P1D4. A typical embodiment of this invention provides methods for monitoring 109P1D4 gene products in a tissue or hematology sample having or suspected of having some form of growth dysregulation such as cancer.

The invention further provides various immunogenic or therapeutic compositions and strategies for treating cancers that express 109P1D4 such as cancers of tissues listed in Table I, including therapies aimed at inhibiting the transcription, translation, processing or function of 109P1D4 as well as cancer vaccines. In one aspect, the invention provides compositions, and methods comprising them, for treating a cancer that expresses 109P1D4 in a human subject wherein the composition comprises a carrier suitable for human use and a human unit dose of one or more than one agent that inhibits the production or function of 109P1D4. Preferably, the carrier is a uniquely human carrier. In another aspect of the invention, the agent is a moiety that is immunoreactive with 109P1D4 protein. Non-limitng examples of such moieties include, but are not limited to, antibodies (such as single chain, monoclonal, polyclonal, humanized, chimeric, or human antibodies), functional equivalents thereof (whether naturally occurring or synthetic), and combinations thereof. The antibodies can be conjugated to a diagnostic or therapeutic moiety. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to 109P1D4 and/or one or more than one peptide which comprises a helper T lymphocyte (HTL) epitope which binds an HLA class II molecule in a human to elicit an HTL response. The peptides of the invention may be on the same or on one or more separate polypeptide molecules. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with 109P1D4 as described above. The one or more than one nucleic acid molecule may also be, or encodes, a molecule that inhibits production of 109P1D4. Non-limiting examples of such molecules include, but are not limited to, those complementary to a nucleotide sequence essential for production of 109P1D4 (e.g. antisense sequences or molecules that form a triple helix with a nucleotide double helix essential for 109P1D4 production) or a ribozyme effective to lyse 109P1D4 mRNA.

Note that to determine the starting position of any peptide set forth in Tables VIII-XXI and XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides in Table VII. Generally, a unique Search Peptide is used to obtain HLA peptides of a particular for a particular variant. The position of each Search Peptide relative to its respective parent molecule is listed in Table VII. Accordingly, if a Search Peptide begins at position "X", one must add the value "X−1" to each position in Tables VIII-XXI and XXII to XLIX to obtain the actual position of the HLA peptides in their parental molecule. For example, if a particular Search Peptide begins at position 150 of its parental molecule, one must add 150−1, i.e., 149 to each HLA peptide amino acid position to calculate the position of that amino acid in the parent molecule.

One embodiment of the invention comprises an HLA peptide, that occurs at least twice in Tables VIII-XXI and XXII to XLIX collectively, or an oligonucleotide that encodes the HLA peptide. Another embodiment of the invention comprises an HLA peptide that occurs at least once in Tables VIII-XXI and at least once in tables XXII to XLIX, or an oligonucleotide that encodes the HLA peptide.

Another embodiment of the invention is antibody epitopes, which comprise a peptide regions, or an oligonucleotide encoding the peptide region, that has one two, three, four, or five of the following characteristics:

i) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a peptide region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or v) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9.

BRIEF DESCRIPTION OF THE FIGURES

FIG. 1. The 109P1D4 SSH sequence of 192 nucleotides.

Figure 11:
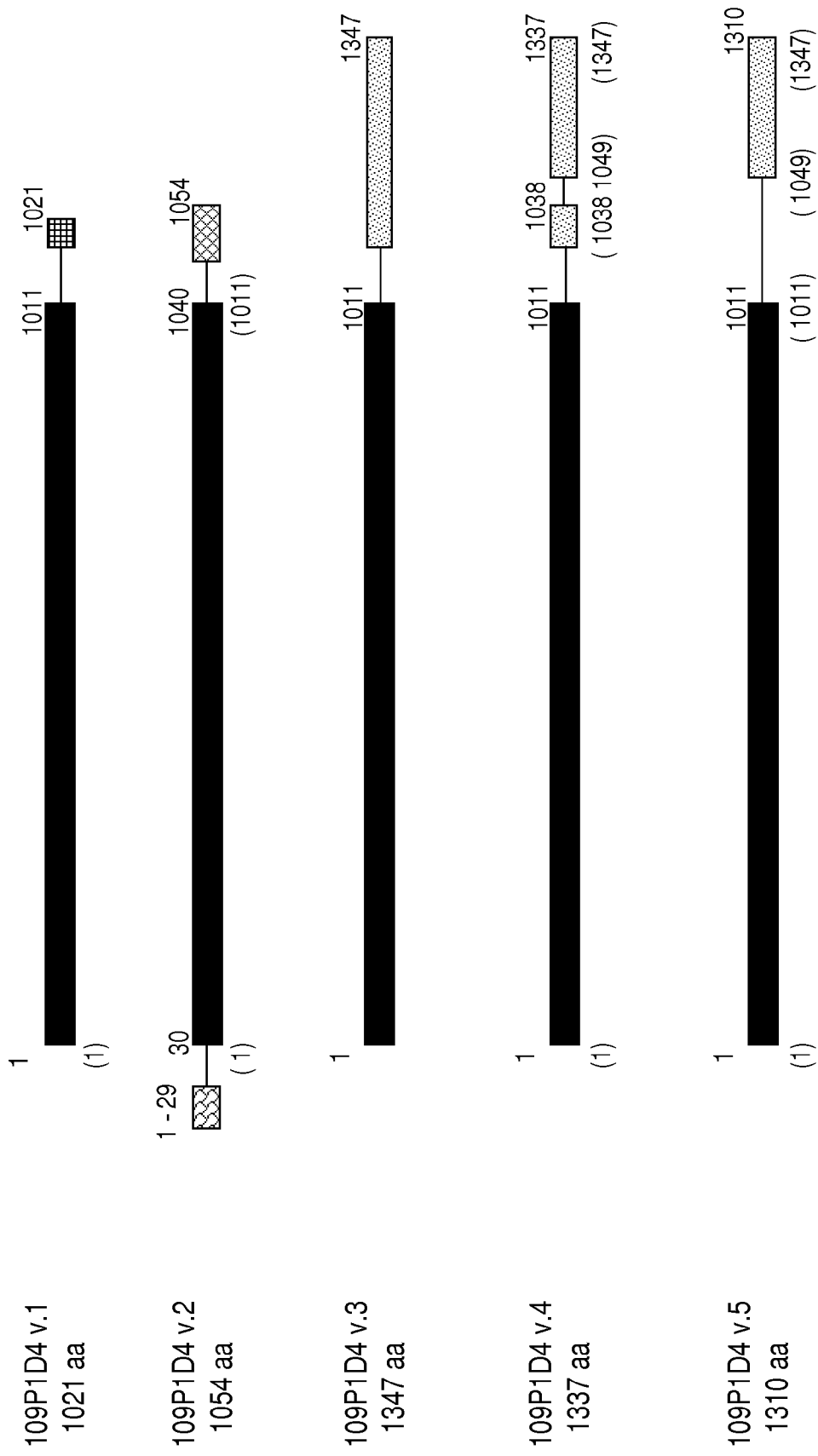

B) The cDNA and amino acid sequence of 109P1D4 variant 2 (also called "109P1D4 v.2") is shown in FIG. 2B. The codon for the start methionine is underlined. The open reading frame extends from nucleic acid 503-3667 including the stop codon.

C) The cDNA and amino acid sequence of 109P1D4 variant 3 (also called "109P1D4 v.3") is shown in FIG. 2C. The codon for the start methionine is underlined. The open reading frame extends from nucleic acid 846-4889 including the stop codon.

D) The cDNA and amino acid sequence of 109P1D4 variant 4 (also called "109P1D4 v.4") is shown in FIG. 2D. The codon for the start methionine is underlined. The open reading frame extends from nucleic acid 846-4859 including the stop codon.

E) The cDNA and amino acid sequence of 109P1D4 variant 5 (also called "109P1D4 v.5") is shown in FIG. 2E. The codon for the start methionine is underlined. The open reading frame extends from nucleic acid 846-4778 including the stop codon.

F) The cDNA and amino acid sequence of 109P1D4 variant 6 (also called "109P1D4 v.6") is shown in FIG. 2F. The codon for the start methionine is underlined. The open reading frame extends from nucleic acid 614-3727 including the stop codon.

G) The cDNA and amino acid sequence of 109P1D4 variant 7 (also called "109P1D4 v.7") is shown in FIG. 2G. The codon for the start methionine is underlined. The open reading frame extends from nucleic acid 735-3881 including the stop codon.

H) The cDNA and amino acid sequence of 109P1D4 variant 8 (also called "109P1D4 v.8") is shown in FIG. 2H. The codon for the start methionine is underlined. The open reading frame extends from nucleic acid 735-4757 including the stop codon.

I) The cDNA and amino acid sequence of 109P1D4 variant 9 (also called "109P1D4 v.9") is shown in FIG. 2I. The codon for the start methionine is underlined. The open reading frame extends from nucleic acid 514-3627 including the stop codon.

J) 109P1D4 v.1, v.2 and v.3 SNP variants. Though these SNP variants are shown separately, they can also occur in any combinations and in any of the transcript variants listed above.

K) 109P1D4 v.6, v.7 and v.8 SNP variants. Though these SNP variants are shown separately, they can also occur in any combinations and in any of the transcript variants listed above.

FIG. 3.

A) The amino acid sequence of 109P1D4 v.1 is shown in FIG. 3A; it has 1021 amino acids.

B) The amino acid sequence of 109P1D4 v.2 is shown in FIG. 3B; it has 1054 amino acids.

C) The amino acid sequence of 109P1D4 v.3 is shown in FIG. 3C; it has 1347 amino acids.

D) The amino acid sequence of 109P1D4 v.4 is shown in FIG. 3D; it has 1337 amino acids.

E) The amino acid sequence of 109P1D4 v.5 is shown in FIG. 3E; it has 1310 amino acids.

F) The amino acid sequence of 109P1D4 v.6 is shown in FIG. 3F; it has 1037 amino acids.

G) The amino acid sequence of 109P1D4 v.7 is shown in FIG. 3G; it has 1048 amino acids.

H) The amino acid sequence of 109P1D4 v.8 is shown in FIG. 3H; it has 1340 amino acids.

I) The amino acid sequence of 109P1D4 v.9 is shown in FIG. 3I; it has 1037 amino acids.

As used herein, a reference to 109P1D4 includes all variants thereof, including those shown in FIGS. 2, 3, 10, 11, and 12 unless the context clearly indicates otherwise.

FIG. 4. Alignment of 109P1D4 v.1 Protein with protocadherin-11.

FIG. 5. Hydrophilicity amino acid profile of 109P1D4 v.1-v.9 determined by computer algorithm sequence analysis using the method of Hopp and Woods (Hopp T. P., Woods K. R., 1981. Proc. Natl. Acad. Sci. U.S.A. 78:3824-3828) accessed on the Protscale website located on the World Wide Web at (.expasy.ch/cgi-bin/protscale.pl) through the ExPasy molecular biology server.

FIG. 6. Hydropathicity amino acid profile of 109P1D4 v.1-v.9 determined by computer algorithm sequence analysis using the method of Kyte and Doolittle (Kyte J., Doolittle R. F., 1982. J. Mol. Biol. 157:105-132) accessed on the ProtScale website located on the World Wide Web at (.expasy.ch/cgi-bin/protscale.pl) through the ExPasy molecular biology server.

FIG. 7. Percent accessible residues amino acid profile of 109P1D4 v.1-v.9 determined by computer algorithm sequence analysis using the method of Janin (Janin J., 1979 Nature 277:491-492) accessed on the ProtScale website located on the World Wide Web at (.expasy.ch/cgi-bin/protscale.pl) through the ExPasy molecular biology server.

FIG. 8. Average flexibility amino acid profile of 109P1D4 v.1-v.9 determined by computer algorithm sequence analysis using the method of Bhaskaran and Ponnuswamy (Bhaskaran R., and Ponnuswamy P. K., 1988. Int. J. Pept. Protein Res. 32:242-255) accessed on the ProtScale website located on the World Wide Web at (.expasy.ch/cgi-bin/protscale.pl) through the ExPasy molecular biology server.

FIG. 9. Beta-turn amino acid profile of 109P1D4 v.1-v.9 determined by computer algorithm sequence analysis using the method of Deleage and Roux (Deleage, G., Roux B. 1987 Protein Engineering 1:289-294) accessed on the ProtScale website located on the World Wide Web at (.expasy.ch/cgi-bin/protscale.pl) through the ExPasy molecular biology server.

FIG. 10. Structure of transcript variants of 109P1D4. Variants 109P1D4 v.2 through v.9 were transcript variants of v.1. Variant v.2 shared middle portion of v.1 sequence (the 3' portion of exon 1 and 5' portion of exon 2). Variant v.6 was similar to v.2 but added an extra exon between exons 1 and 2 of v.2. V.3 shared exon 1 and 5' portion of exon 2 with v.1 with five additional exons downstream. Compared with v.3, v.4 deleted exon 4 of v.3 while v.5 deleted exons 3 and 4 of v.3. Variant v.5 lacked exons 3 and 4. This gene (called PCD11) is located in sex chromosomes X and Y. Ends of exons in the transcripts are marked above the boxes. Potential exons of this gene are shown in order as on the human genome. Poly A tails and single nucleotide differences are not shown in the figure. Lengths of introns and exons are not proportional.

FIG. 11. Schematic alignment of protein variants of 109P11D4. Variants 109P1D4 v.2 through v.9 were proteins translated from the corresponding transcript variants. All these protein variants shared a common portion of the sequence, i.e., 3-1011 of v.1, except for a few amino acids different in this segment resulted from SNP in the transcripts. Variant v.6 and v.9 were the same except for two amino acids at 906 and 1001. Variant v.8 was almost the same as v.5, except for the N-terminal end, and a 2-aa deletion at 1117-8. Single amino acid difference was not shown. Numbers in parentheses corresponded to positions in variant v.3.

FIG. 12. Effect of 109P1D4 RNAi on cell proliferation. LNCaP cells were transfected with Lipofectamine 2000 alone or with siRNA oligonucleotides. The siRNA oligonucleotides included a negative control, Luc4, specific for Luciferase, a positive control, Eg5, specific for the mitotic spindle protein Eg5, or three siRNAs specific for the 109P1D4 protein, 109P1D4.a, 109P1D4.c and 109P1D4.d at 20 nM concentration. Twenty four hours after transfection, the cells were pulsed with $^3$H-thymidine and incorporation was measured after 72 hours. All three siRNAs to 109P1D4 inhibited the proliferation of LNCaP cells, indicating that 109P1D4 expression is important for the cell growth pathway of these cancer cells.

FIG. 13. FIGS. 13(a)-(i): Secondary structure and transmembrane domains prediction for 109P1D4 protein variants 1-9 (v.1—(SEQ ID NO: 31); v.2—(SEQ ID NO: 32); v.3—(SEQ ID NO: 33); v.4—(SEQ ID NO: 34); v.5—(SEQ ID NO: 35); v.6—(SEQ ID NO: 36); v.7—(SEQ ID NO, 37); v.8—(SEQ ID NO: 38); v.9—(SEQ ID NO: 39)). The secondary structures of 109P1D4 protein variants were predicted using the HNN—Hierarchical Neural Network method (NPS@: Network Protein Sequence Analysis TIBS 2000 March Vol. 25, No 3 [291]:147-150 Combet C., Blanchet C., Geourjon C. and Deléage G., http://pbil.ibcp.fr/cgi-bin/npsa_automat.pl?page=nps_nn.html), accessed from the ExPasy molecular biology server located on the World Wide Web at (.expasy.ch/tools/). This method predicts the presence and location of alpha helices, extended strands, and random coils from the primary protein sequence. The percent of the protein variant in a given secondary structure is also listed. FIGS. 13(J)-(R) top panels: Schematic representation of the probability of existence of transmembrane regions of 109P1D4 variants based on the TMpred algorithm of Hofmann and Stoffel which utilizes TMBASE (K. Hofmann, W. Stoffel. TMBASE—A database of membrane spanning protein segments Biol. Chem. Hoppe-Seyler 374:166, 1993). FIGS. 13(J)-(R) bottom panels: Schematic representation of the probability of the existence of transmembrane regions of 109P1D4 variants based on the TMHMM algorithm of Sonnhammer, von Heijne, and Krogh (Erik L. L. Sonnhammer, Gunnar von Heijne, and Anders Krogh: A hidden Markov model for predicting transmembrane helices in protein sequences. In Proc. of Sixth Int. Conf. on Intelligent Systems for Molecular Biology, p 175-182 Ed J. Glasgow, T. Littlejohn, F. Major, R. Lathrop, D. Sankoff, and C. Sensen Menlo Park, Calif.: AAAI Press, 1998). The TMpred and TMHMM algorithms are accessed from the ExPasy molecular biology server located on the World Wide Web at (.expasy.ch/tools/).

FIG. 14. Expression of 109P1D4 in Lymphoma Cancer Patient Specimens. RNA was extracted from peripheral blood lymphocytes, cord blood isolated from normal individuals, and from lymphoma patient cancer specimens. Northern blots with 10 μg of total RNA were probed with the 109P1D4 sequence. Size standards in kilobases are on the side. Results show expression of 109P1D4 in lymphoma patient specimens but not in the normal blood cells tested.

FIG. 15. Expression of 109P1D4 by RT-PCR. First strand cDNA was prepared from vital pool 1 (liver, lung and kidney), vital pool 2 (pancreas, colon and stomach), prostate cancer pool, bladder cancer pool, kidney cancer pool, colon cancer pool, lung cancer pool, ovary cancer pool, breast cancer pool, cancer metastasis pool, and pancreas cancer pool. Normalization was performed by PCR using primers to actin and GAPDH. Semi-quantitative PCR, using primers to 109P1D4, was performed at 30 cycles of amplification. Results show strong expression of 109P1D4 in all cancer pools tested. Very low expression was detected in the vital pools.

FIG. 16. Expression of 109P1D4 in normal tissues. Two multiple tissue northern blots (Clontech), both with 2 μpg of mRNA/lane, were probed with the 109P1D4 SSH fragment. Size standards in kilobases (kb) are indicated on the side. Results show expression of approximately 10 kb 109P1D4 transcript in ovary. Weak expression was also detected in placenta and brain, but not in the other normal tissues tested.

FIG. 17. Expression of 109P1D4 in human cancer cell lines. RNA was extracted from a number of human prostate and bone cancer cell lines. Northern blots with 10 μg of total RNA/lane were probed with the 109P1D4 SSH fragment. Size standards in kilobases (kb) are indicated on the side. Results show expression of 109P1D4 in LAPC-9AD, LAPC-9AI, LNCaP prostate cancer cell lines, and in the bone cancer cell lines, SK-ES-1 and RD-ES.

FIG. 18. FIG. 18A: 109P1D4 Expression in Human Normal Tissues. An cDNA dot blot containing 76 different samples from human tissues was analyzed using a 109P1D4 SSH probe. Expression was only detected in multiple areas of the brain, placenta, ovary, and fetal brain, amongst all tissues tested. FIG. 18B: Expression of 109P1D4 in patient cancer specimens. Expression of 109P1D4 was assayed in a panel of human cancers (T) and their respective matched normal tissues (N) on RNA dot blots. Upregulated expression of 109P1D4 in tumors compared to normal tissues was observed in uterus, lung and stomach. The expression detected in normal adjacent tissues (isolated from diseased tissues) but not in normal tissues (isolated from healthy donors) may indicate that these tissues are not fully normal and that 109P1D4 may be expressed in early stage tumors.

FIG. 19. 109P1D4 Expression in Lung Cancer Patient Specimens. RNA was extracted from normal lung, prostate cancer xenograft LAPC-9AD, bone cancer cell line RD-ES, and lung cancer patient tumors. Northern blots with 10 μg of total RNA were probed with 109P1D4. Size standards in kilobases are on the side. Results show strong expression of 109P1D4 in lung tumor tissues as well as the RD-ES cell line, but not in normal lung.

FIG. 20. Expression of soluble secreted Tag5 109P1D4 in 293T cells. 293T cells were transfected with either an empty vector or with the Tag5 secretion vector encoding the extracellular domain (ECD; amino acids 24-812) of 109P1D4 variant 1 fused to a Myc/His epitope Tag. 2 days later, cells and media harvested and analyzed for expression of the recombinant Tag5 109P1D4 protein by SDS-PAGE followed by anti-His epitope tag Western blotting. An arrow indicates the immunoreactive band corresponding to the 109P1D4 ECD present in the media and the lysate from Tag5 109P1D4 transfected cells.

FIG. 21. Expression of 109P1D4 protein in 293T cells. 293T cells were transfected with either an empty vector or with pCDNA3.1 vector encoding the full length cDNA of 109P1D4 variant 1 fused to a Myc/His epitope Tag. 2 days later, cells were harvested and analyzed for expression of 109P1D4 variant 1 protein by SDS-PAGE followed by anti-His epitope tag Western blotting. An arrow indicates the immunoreactive band corresponding to the full length 109P1D4 variant 1 protein expressed in cells transfected with the 109P1D4 vector but not in control cells.

FIG. 22. Tyrosine phosphorylation of 109P1D4 after pervanadate treatment. 293T cells were transfected with the neomycin resistance gene alone or with 109P1D4 in pSRμ vector. Twenty four hours after transfection, the cells were either left in 10% serum or grown in 0.1% serum overnight. The cells were then left untreated or were treated with 200 μM pervanadate (1:1 mixture of $Na_3VO_4$ and $H_2O_2$) for 30 minutes. The cells were lysed in Triton X-100, and the 109P1D4 protein was immunoprecipitated with anti-His monoclonal antibody. The immunoprecipitates were run on SDS-PAGE and then Western blotted with either anti-phosphotyrosine (upper panel) or anti-His (lower panel). The 109P1D4 protein is phosphorylated on tyrosine in response to pervanadate treatment, and a large amount of the protein moves to the insoluble fraction following pervanadate-induced activation.

DETAILED DESCRIPTION OF THE INVENTION

Outline of Sections
I.) Definitions
II.) 109P1D4 Polynucleotides
II.A.) Uses of 109P1D4 Polynucleotides
II.A.1.) Monitoring of Genetic Abnormalities
II.A.2.) Antisense Embodiments
II.A.3.) Primers and Primer Pairs
II.A.4.) Isolation of 109P1D4-Encoding Nucleic Acid Molecules
II.A.5.) Recombinant Nucleic Acid Molecules and Host-Vector Systems
III.) 109P1D4-related Proteins
III.A.) Motif-bearing Protein Embodiments
III.B.) Expression of 109P1D4-related Proteins
III.C.) Modifications of 109P1D4-related Proteins
III.D.) Uses of 109P1D4-related Proteins
IV.) 109P1D4 Antibodies
V.) 109P1D4 Cellular Immune Responses
VI.) 109P1D4 Transgenic Animals
VII.) Methods for the Detection of 109P1D4
VII.) Methods for Monitoring the Status of 109P1D4-related Genes and Their Products
IX.) Identification of Molecules That Interact With 109P1D4
X.) Therapeutic Methods and Compositions
X.A.) Anti-Cancer Vaccines
X.B.) 109P1D4 as a Target for Antibody-Based Therapy
X.C.) 109P1D4 as a Target for Cellular Immune Responses
X.C.1. Minigene Vaccines
X.C.2. Combinations of CTL Peptides with Helper Peptides
X.C.3. Combinations of CTL Peptides with T Cell Priming Agents
X.C.4. Vaccine Compositions Comprising DC Pulsed with CTL and/or HTL Peptides
X.D.) Adoptive Immunotherapy
X.E.) Administration of Vaccines for Therapeutic or Prophylactic Purposes
XI.) Diagnostic and Prognostic Embodiments of 109P1D4.
XII.) Inhibition of 109P1D4 Protein Function
XII.A.) Inhibition of 109P1D4 With Intracellular Antibodies
XII.B.) Inhibition of 109P1D4 with Recombinant Proteins
XII.C.) Inhibition of 109P1D4 Transcription or Translation
XII.D.) General Considerations for Therapeutic Strategies
XIII.) Identification, Characterization and Use of Modulators of 109P1D4
XIV.) KITS/Articles of Manufacture
I.) Definitions:

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer," "locally advanced prostate cancer," "advanced disease" and "locally advanced disease" mean prostate cancers that have extended through the prostate capsule, and are meant to include stage C disease under the American Urological Association (AUA) system, stage C1-C2 disease under the Whitmore-Jewelt system, and stage T3-T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence 109P1D4 (either by removing the underlying glycosylation site or by deleting the glycosylation by chemical and/or enzymatic means), and/or adding one or more glycosylation sites that are not present in the native sequence 109P1D4. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a 109P1D4-related protein). For example, an analog of a 109P1D4 protein can be specifically bound by an antibody or T cell that specifically binds to 109P1D4.

The term "antibody" is used in the broadest sense. Therefore, an "antibody" can be naturally occurring or man-made such as monodonal antibodies produced by conventional hybridoma technology. Anti-109P1D4 antibodies comprise monoclonal and polydonal antibodies as well as fragments containing the antigen-binding domain and/or one or more complementarity determining regions of these antibodies.

An "antibody fragment" is defined as at least a portion of the variable region of the immunoglobulin molecule that binds to its target, i.e., the antigen-binding region. In one embodiment it specifically covers single anti-109P1D4 antibodies and clones thereof (including agonist, antagonist and neutralizing antibodies) and anti-109P1D4 antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

A "combinatorial library" is a collection of diverse chemical compounds generated by either chemical synthesis or biological synthesis by combining a number of chemical "building blocks" such as reagents. For example, a linear combinatorial chemical library, such as a polypeptide (e.g., mutein) library, is formed by combining a set of chemical building blocks called amino acids in every possible way for a given compound length (i.e., the number of amino acids in a polypeptide compound). Numerous chemical compounds are synthesized through such combinatorial mixing of chemical building blocks (Gallop et al., J. Med. Chem. 37(9): 1233-1251 (1994)).

Preparation and screening of combinatorial libraries is well known to those of skill in the art. Such combinatorial chemical libraries include, but are not limited to, peptide libraries (see, e.g., U.S. Pat. No. 5,010,175, Furka, Pept. Prot. Res. 37:487-493 (1991), Houghton et al., Nature, 354:84-88 (1991)), peptoids (PCT Publication No WO 91/19735), encoded peptides (PCT Publication WO 93/20242), random bio-oligomers (PCT Publication WO 92/00091), benzodiazepines (U.S. Pat. No. 5,288,514), diversomers such as hydantoins, benzodiazepines and dipeptides (Hobbs et al., Proc. Nat. Acad. Sci. USA 90:6909-6913 (1993)), vinylogous polypeptides (Hagihara et al., J. Amer. Chem. Soc. 114:6568 (1992)), nonpeptidal peptidomimetics with a Beta-D-Glucose scaffolding (Hirschmann et al., J. Amer. Chem. Soc. 114:9217-9218 (1992)), analogous organic syntheses of small compound libraries (Chen et al., J. Amer. Chem. Soc. 116:2661 (1994)), oligocarbarnates (Cho, et al., Science 261: 1303 (1993)), and/or peptidyl phosphonates (Campbell et al., J. Org. Chem. 59:658 (1994)). See, generally, Gordon et al., J. Med. Chem. 37:1385 (1994), nucleic acid libraries (see, e.g., Stratagene, Corp.), peptide nucleic acid libraries (see, e.g., U.S. Pat. No. 5,539,083), antibody libraries (see, e.g., Vaughn et al., Nature Biotechnology 14(3): 309-314 (1996), and PCT/US96/10287), carbohydrate libraries (see, e.g., Liang et al., Science 274:1520-1522 (1996), and U.S. Pat. No. 5,593,853), and small organic molecule libraries (see, e.g., benzodiazepines, Baum, C&EN, January 18, page 33 (1993); isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506,337; benzodiazepines, U.S. Pat. No. 5,288, 514; and the like).

Devices for the preparation of combinatorial libraries are commercially available (see, e.g., 357 NIPS, 390 NIPS, Advanced Chem Tech, Louisville Ky.; Symphony, Rainin, Woburn, Mass.; 433A, Applied Biosystems, Foster City, Calif.; 9050, Plus, Millipore, Bedford, NIA). A number of well-known robotic systems have also been developed for solution phase chemistries. These systems include automated workstations such as the automated synthesis apparatus developed by Takeda Chemical Industries, LTD. (Osaka, Japan) and many robotic systems utilizing robotic arms (Zymate H, Zymark Corporation, Hopkinton, Mass.; Orca, Hewlett-Packard, Palo Alto, Calif.), which mimic the manual synthetic operations performed by a chemist. Any of the above devices are suitable for use with the present invention. The nature and implementation of modifications to these devices (if any) so that they can operate as discussed herein will be apparent to persons skilled in the relevant art. In addition, numerous combinatorial libraries are themselves commercially available (see, e.g., ComGenex, Princeton, N.J.; Asinex, Moscow, RU; Tripos, Inc., St. Louis, Mo.; ChemStar, Ltd, Moscow, RU; 3D Pharmaceuticals, Exton, Pa.; Martek Biosciences, Columbia, Md.; etc.).

The term "cytotoxic agent" refers to a substance that inhibits or prevents the expression activity of cells, function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to auristatins, auromycins, maytansinoids, yttrium, bismuth, ricin, ricin A-chain, combrestatin, duocarmycins, dolostatins, doxorubicin, daunorubicin, taxol, cisplatin, cc1065, ethidium bromide, mitomycin, etoposide, tenoposide, vincristine, vinblastine, colchicine, dihydroxy anthracin dione, actinomycin, diphtheria toxin, Pseudomonas exotoxin (PE) A, PE40, abrin, abrin A chain, modeccin A chain, alpha-sarcin, gelonin, mitogellin, retstrictocin, phenomycin, enomycin, curicin, crotin, calicheamicin, Sapaonaria officinalis inhibitor, and glucocorticoid and other chemotherapeutic agents, as well as radioisotopes such as $At^{211}$, $I^{131}$, $I^{125}$, $Y^{90}$, $Re^{186}$, $Re^{188}$, $Sm^{153}$, $Bi^{212\ or\ 213}$, $P^{32}$ and radioactive isotopes of Lu including $Lu^{177}$. Antibodies may also be conjugated to an anti-cancer pro-drug activating enzyme capable of converting the pro-drug to its active form.

The "gene product" is sometimes referred to herein as a protein or mRNA. For example, a "gene product of the invention" is sometimes referred to herein as a "cancer amino acid sequence", "cancer protein", "protein of a cancer listed in Table I", a "cancer mRNA", "mRNA of a cancer listed in Table I", etc. In one embodiment, the cancer protein is encoded by a nucleic acid of FIG. 2. The cancer protein can be a fragment, or alternatively, be the full-length protein to the fragment encoded by the nucleic acids of FIG. 2. In one embodiment, a cancer amino acid sequence is used to determine sequence identity or similarity. In another embodiment, the sequences are naturally occurring allelic variants of a protein encoded by a nucleic acid of FIG. 2. In another embodiment, the sequences are sequence variants as further described herein.

"High throughput screening" assays for the presence, absence, quantification, or other properties of particular nucleic acids or protein products are well known to those of skill in the art. Similarly, binding assays and reporter gene assays are similarly well known. Thus, e.g., U.S. Pat. No. 5,559,410 discloses high throughput screening methods for proteins; U.S. Pat. No. 5,585,639 discloses high throughput screening methods for nucleic acid binding (i.e., in arrays); while U.S. Pat. Nos. 5,576,220 and 5,541,061 disclose high throughput methods of screening for ligand/antibody binding.

In addition, high throughput screening systems are commercially available (see, e.g., Amersham Biosciences, Piscataway, N.J.; Zymark Corp., Hopkinton, Mass.; Air Technical Industries, Mentor, Ohio; Beckman Instruments, Inc. Fullerton, Calif.; Precision Systems, Inc., Natick, Mass.; etc.). These systems typically automate entire procedures, including all sample and reagent pipetting, liquid dispensing, timed incubations, and final readings of the microplate in detector(s) appropriate for the assay. These configurable systems provide high throughput and rapid start up as well as a high degree of flexibility and customization. The manufacturers of such systems provide detailed protocols for various high throughput systems. Thus, e.g., Zymark Corp. provides technical bulletins describing screening systems for detecting the modulation of gene transcription, ligand binding, and the like.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6×SSC/0.1% SDS/100 µg/ml ssDNA, in which temperatures for hybridization are above 37 degrees C. and temperatures for washing in 0.1×SSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the 109P1D4 genes or that encode polypeptides other than 109P1D4 gene product or fragments thereof. A skilled artisan can readily employ nucleic acid isolation procedures to obtain an isolated 109P1D4 polynucleotide. A protein is said to be "isolated," for example, when physical, mechanical or chemical methods are employed to remove the 109P1D4 proteins from cellular constituents that are normally associated with the protein. A skilled artisan can readily employ standard purification methods to obtain an isolated 109P1D4 protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage TxNxM+ under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "modulator" or "test compound" or "drug candidate" or grammatical equivalents as used herein describe any molecule, e.g., protein, oligopeptide, small organic molecule, polysaccharide, polynucleotide, etc., to be tested for the capacity to directly or indirectly alter the cancer phenotype or the expression of a cancer sequence, e.g., a nucleic acid or protein sequences, or effects of cancer sequences (e.g., signaling, gene expression, protein interaction, etc.) In one aspect, a modulator will neutralize the effect of a cancer protein of the invention. By "neutralize" is meant that an activity of a protein is inhibited or blocked, along with the consequent effect on the cell. In another aspect, a modulator will neutralize the effect of a gene, and its corresponding protein, of the invention by normalizing levels of said protein. In preferred embodiments, modulators alter expression profiles, or expression profile nucleic acids or proteins provided herein, or downstream effector pathways. In one embodiment, the modulator suppresses a cancer phenotype, e.g. to a normal tissue fingerprint. In another embodiment, a modulator induced a cancer phenotype. Generally, a plurality of assay mixtures is run in parallel with different agent concentrations to obtain a differential response to the various concentrations. Typically, one of these concentrations serves as a negative control, i.e., at zero concentration or below the level of detection.

Modulators, drug candidates or test compounds encompass numerous chemical classes, though typically they are organic molecules, preferably small organic compounds having a molecular weight of more than 100 and less than about 2,500 Daltons. Preferred small molecules are less than 2000, or less than 1500 or less than 1000 or less than 500 D. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Modulators also comprise biomolecules such as peptides, saccharides, fatty acids, steroids, purines, pyrimidines, derivatives, structural analogs or combinations thereof. Particularly preferred are peptides. One class of modulators are peptides, for example of from about five to about 35 amino acids, with from about five to about 20 amino acids being preferred, and from about 7 to about 15 being particularly preferred. Preferably, the cancer modulatory protein is soluble, includes a non-transmembrane region, and/or has an N-terminal Cys to aid in solubility. In one embodiment, the C-terminus of the fragment is kept as a free acid and the N-terminus is a free amine to aid in coupling, i.e., to cysteine. In one embodiment, a cancer protein of the invention is conjugated to an immunogenic agent as discussed herein. In one embodiment, the cancer protein is conjugated to BSA. The peptides of the invention, e.g., of preferred lengths, can be linked to each other or to other amino acids to create a longer peptide/protein. The modulatory peptides can be digests of naturally occurring proteins as is outlined above, random peptides, or "biased" random peptides. In a preferred embodiment, peptide/protein-based modulators are antibodies, and fragments thereof, as defined herein.

Modulators of cancer can also be nucleic acids. Nucleic acid modulating agents can be naturally occurring nucleic acids, random nucleic acids, or "biased" random nucleic acids. For example, digests of prokaryotic or eukaryotic genomes can be used in an approach analogous to that outlined above for proteins.

The term "monoclonal antibody" refers to an antibody obtained from a population of substantially homogeneous antibodies, i.e., the antibodies comprising the population are identical except for possible naturally occurring mutations that are present in minor amounts.

A "motif, as in biological motif of a 109P1D4-related protein, refers to any pattern of amino acids forming part of the primary sequence of a protein, that is associated with a particular function (e.g. protein-protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymidine (T), as shown for example in FIG. 2, can also be uracil (U); this definition pertains to the differences between the chemical structures of DNA and RNA, in particular the observation that one of the four major bases in RNA is uracil (U) instead of thymidine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. Alternatively, in another embodiment, the primary anchor residues of a peptide binds an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif.

"Radioisotopes" include, but are not limited to the following (non-limiting exemplary uses are also set forth):
Examples of Medical Isotopes:

| Isotope | Description of use |
|---|---|
| Actinium-225 (AC-225) | See Thorium-229 (Th-229) |
| Actinium-227 (AC-227) | Parent of Radium-223 (Ra-223) which is an alpha emitter used to treat metastases in the skeleton resulting from cancer (i.e., breast and prostate cancers), and cancer radioimmunotherapy |
| Bismuth-212 (Bi-212) | See Thorium-228 (Th-228) |
| Bismuth-213 (Bi-213) | See Thorium-229 (Th-229) |
| Cadmium-109 (Cd-109) | Cancer detection |
| Cobalt-60 (Co-60) | Radiation source for radiotherapy of cancer, for food irradiators, and for sterilization of medical supplies |
| Copper-64 (Cu-64) | A positron emitter used for cancer therapy and SPECT imaging |
| Copper-67 (Cu-67) | Beta/gamma emitter used in cancer radioimmunotherapy and diagnostic studies (i.e., breast and colon cancers, and lymphoma) |
| Dysprosium-166 (Dy-166) | Cancer radioimmunotherapy |
| Erbium-169 (Er-169) | Rheumatoid arthritis treatment, particularly for the small joints associated with fingers and toes |
| Europium-152 (Eu-152) | Radiation source for food irradiation and for sterilization of medical supplies |
| Europium-154 (Eu-154) | Radiation source for food irradiation and for sterilization of medical supplies |
| Gadolinium-153 (Gd-153) | Osteoporosis detection and nuclear medical quality assurance devices |
| Gold-198 (Au-198) | Implant and intracavity therapy of ovarian, prostate, and brain cancers |
| Holmium-166 (Ho-166) | Multiple myeloma treatment in targeted skeletal therapy, cancer radioimmunotherapy, bone marrow ablation, and rheumatoid arthritis treatment |

| Isotope | Description of use |
|---|---|
| Iodine-125 (I-125) | Osteoporosis detection, diagnostic imaging, tracer drugs, brain cancer treatment, radiolabeling, tumor imaging, mapping of receptors in the brain, interstitial radiation therapy, brachytherapy for treatment of prostate cancer, determination of glomerular filtration rate (GFR), determination of plasma volume, detection of deep vein thrombosis of the legs |
| Iodine-131 (I-131) | Thyroid function evaluation, thyroid disease detection, treatment of thyroid cancer as well as other non-malignant thyroid diseases (i.e., Graves disease, goiters, and hyperthyroidism), treatment of leukemia, lymphoma, and other forms of cancer (e.g., breast cancer) using radioimmunotherapy |
| Iridium-192 (Ir-192) | Brachytherapy, brain and spinal cord tumor treatment, treatment of blocked arteries (i.e., arteriosclerosis and restenosis), and implants for breast and prostate tumors |
| Lutetium-177 (Lu-177) | Cancer radioimmunotherapy and treatment of blocked arteries (i.e., arteriosclerosis and restenosis) |
| Molybdenum-99 (Mo-99) | Parent of Technetium-99m (Tc-99m) which is used for imaging the brain, liver, lungs, heart, and other organs. Currently, Tc-99m is the most widely used radioisotope used for diagnostic imaging of various cancers and diseases involving the brain, heart, liver, lungs; also used in detection of deep vein thrombosis of the legs |
| Osmium-194 (Os-194) | Cancer radioimmunotherapy |
| Palladium-103 (Pd-103) | Prostate cancer treatment |
| Platinum-195m (Pt-195m) | Studies on biodistribution and metabolism of cisplatin, a chemotherapeutic drug |
| Phosphorus-32 (P-32) | Polycythemia rubra vera (blood cell disease) and leukemia treatment, bone cancer diagnosis/treatment; colon, pancreatic, and liver cancer treatment; radiolabeling nucleic acids for in vitro research, diagnosis of superficial tumors, treatment of blocked arteries (i.e., arteriosclerosis and restenosis), and intracavity therapy |
| Phosphorus-33 (P-33) | Leukemia treatment, bone disease diagnosis/treatment, radiolabeling, and treatment of blocked arteries (i.e., arteriosclerosis and restenosis) |
| Radium-223 (Ra-223) | See Actinium-227 (Ac-227) |
| Rhenium-186 (Re-186) | Bone cancer pain relief, rheumatoid arthritis treatment, and diagnosis and treatment of lymphoma and bone, breast, colon, and liver cancers using radioimmunotherapy |
| Rhenium-188 (Re-188) | Cancer diagnosis and treatment using radioimmunotherapy, bone cancer pain relief, treatment of rheumatoid arthritis, and treatment of prostate cancer |
| Rhodium-105 (Rh-105) | Cancer radioimmunotherapy |
| Samarium-145 (Sm-145) | Ocular cancer treatment |
| Samarium-153 (Sm-153) | Cancer radioimmunotherapy and bone cancer pain relief |
| Scandium-47 (Sc-47) | Cancer radioimmunotherapy and bone cancer pain relief |
| Selenium-75 (Se-75) | Radiotracer used in brain studies, imaging of adrenal cortex by gamma-scintigraphy, lateral locations of steroid secreting tumors, pancreatic scanning, detection of hyperactive parathyroid glands, measure rate of bile acid loss from the endogenous pool |
| Strontium-85 (Sr-85) | Bone cancer detection and brain scans |
| Strontium-89 (Sr-89) | Bone cancer pain relief, multiple myeloma treatment, and osteoblastic therapy |
| Technetium-99m (Tc-99m) | See Molybdenum-99 (Mo-99) |
| Thorium-228 (Th-228) | Parent of Bismuth-212 (Bi-212) which is an alpha emitter used in cancer radioimmunotherapy |
| Thorium-229 (Th-229) | Parent of Actinium-225 (Ac-225) and grandparent of Bismuth-213 (Bi-213) which are alpha emitters used in cancer radioimmunotherapy |
| Thulium-170 (Tm-170) | Gamma source for blood irradiators, energy source for implanted medical devices |
| Tin-117m (Sn-117m) | Cancer immunotherapy and bone cancer pain relief |
| Tungsten-188 (W-188) | Parent for Rhenium-188 (Re-188) which is used for cancer diagnostics/treatment, bone cancer pain relief, rheumatoid arthritis treatment, and treatment of blocked arteries (i.e., arteriosclerosis and restenosis) |
| Xenon-127 (Xe-127) | Neuroimaging of brain disorders, high resolution SPECT studies, pulmonary function tests, and cerebral blood flow studies |
| Ytterbium-175 (Yb-175) | Cancer radioimmunotherapy |
| Yttrium-90 (Y-90) | Microseeds obtained from irradiating Yttrium-89 (Y-89) for liver cancer treatment |
| Yttrium-91 (Y-91) | A gamma-emitting label for Yttrium-90 (Y-90) which is used for cancer radioimmunotherapy (i.e., lymphoma, breast, colon, kidney, lung, ovarian, prostate, pancreatic, and inoperable liver cancers) |

By "randomized" or grammatical equivalents as herein applied to nucleic adds and proteins is meant that each nucleic add and peptide consists of essentially random nucleotides and amino adds, respectively. These random peptides (or nucleic acids, discussed herein) can incorporate any nucleotide or amino acid at any position. The synthetic process can be designed to generate randomized proteins or nucleic acids, to allow the formation of all or most of the possible combinations over the length of the sequence, thus forming a library of randomized candidate bioactive proteinaceous agents.

In one embodiment, a library is "fully randomized," with no sequence preferences or constants at any position. In another embodiment, the library is a "biased random" library. That is, some positions within the sequence either are held constant, or are selected from a limited number of possibilities. For example, the nucleotides or amino acid residues are randomized within a defined class, e.g., of hydrophobic amino acids, hydrophilic residues, sterically biased (either small or large) residues, towards the creation of nucleic acid binding domains, the creation of cysteines, for cross-linking, prolines for SH-3 domains, serines, threonines, tyrosines or histidines for phosphorylation sites, etc., or to purines, etc.

"A recombinant" DNA or RNA molecule is a DNA or RNA molecule that has been subjected to molecular manipulation in vitro.

Non-limiting examples of small molecules include compounds that bind or interact with 109P1D4, ligands including hormones, neuropeptides, chemokines, odorants, phospholipids, and functional equivalents thereof that bind and preferably inhibit 109P1D4 protein function. Such non-limiting small molecules preferably have a molecular weight of less than about 10 kDa, more preferably below about 9, about 8, about 7, about 6, about 5 or about 4 kDa. In certain embodiments, small molecules physically associate with, or bind, 109P1D4 protein; are not found in naturally occurring metabolic pathways; and/or are more soluble in aqueous than non-aqueous solutions "Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al, Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 µg/ml), 0.1% SDS, and 10% dextran sulfate at 42° C., with washes at 42° C. in 0.2×SSC (sodium chloride/sodium. citrate) and 50% formamide at 55° C., followed by a high-stringency wash consisting of 0.1×SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and % SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5× Denhardt's solution, 10% dextran sulfate, and 20 mg/mL denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles. Overall phenotypic frequencies of HLA-supertypes in different ethnic populations are set forth in Table IV (F). The non-limiting constituents of various supertypes are as follows:

A2: A*0201, A*0202, A*0203, A*0204, A*0205, A*0206, A*6802, A*6901, A*0207

A3: A3, A11, A31, A*3301, A*6801, A*0301, A*1101, A*3101

B7: B7, B*3501-03, B*51, B*5301, B*5401, B*5501, B*5502, B*5601, B*6701, B*7801, B*0702, B*5101, B*5602

B44: B*3701, B*4402, B*4403, B*60 (B*4001), B61 (B*4006)

A1: A*0102, A*2604, A*3601, A*4301, A*8001

A24: A*24, A*30, A*2403, A*2404, A*3002, A*3003

B27: B*1401-02, B*1503, B*1509, B*1510, B*1518, B*3801-02, B*3901, B*3902, B*3903-04, B*4801-02, B*7301, B*2701-08

B58: B*1516, B*1517, B*5701, B*5702, B58

B62: B*4601, B52, B*1501 (B62), B*1502 (B75), B*1513 (B77)

Calculated population coverage afforded by different HLA-supertype combinations are set forth in Table IV (G).

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, e.g., a minigene that encodes a polyepitopic peptide. The "one or more peptides" can include any whole unit integer from 1-150 or more, e.g., at least 2, 3, 4, 5, 6, 7, 8, 9, 10, 11,12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g., dendritic cells.

Figures 2, 11:
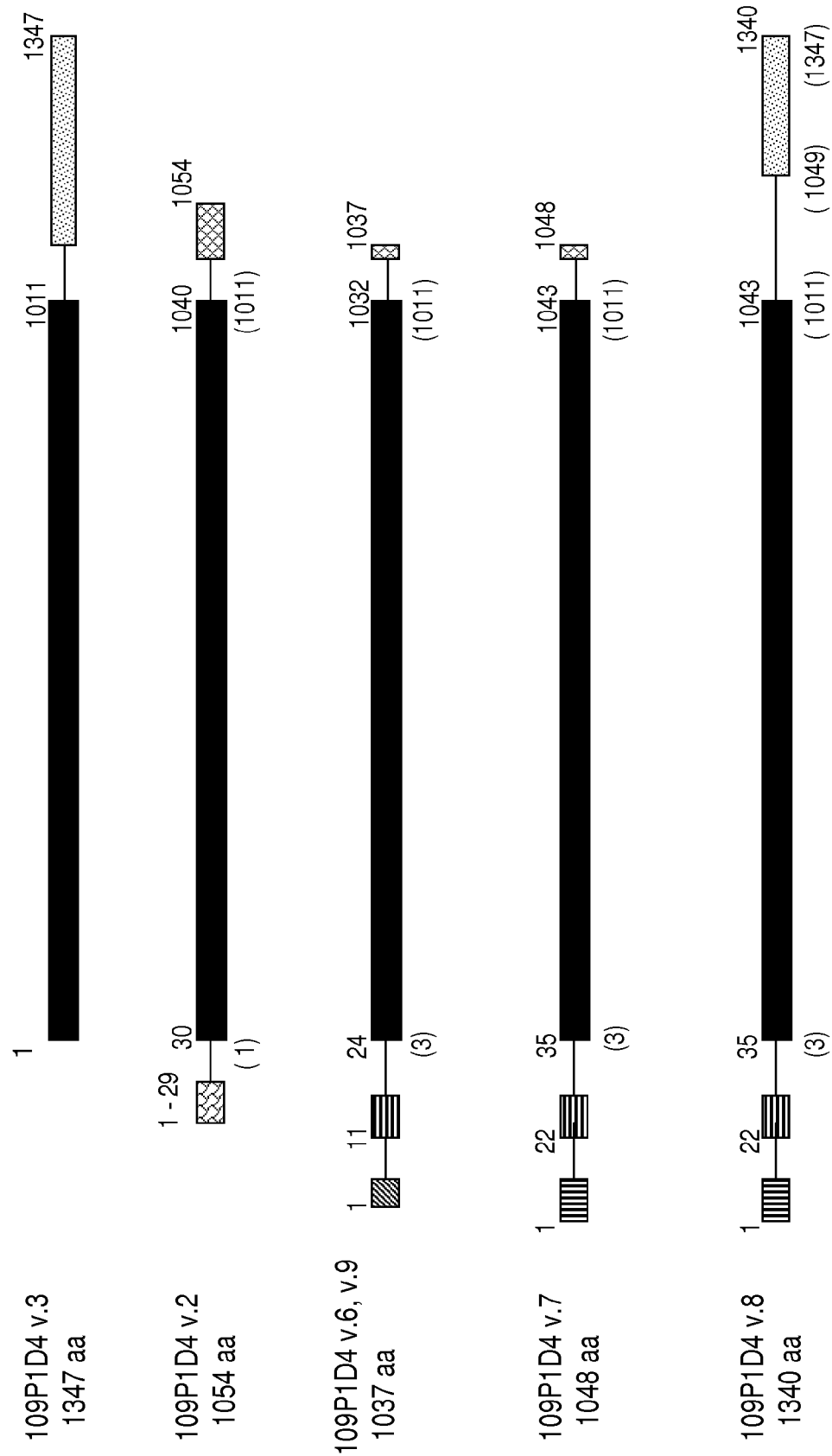
FIG. 2. A) The cDNA and amino acid sequence of 109P1D4 variant 1 (also called "109P1D4 v.1" or "109P1D4 variant 1") is shown in FIG. 2A. The start methionine is underlined. The open reading frame extends from nucleic acid 846-3911 including the stop codon.

The term "variant" refers to a molecule that exhibits a variation from a described type or norm, such as a protein that has one or more different amino acid residues in the corresponding position(s) of a specifically described protein (e.g. the 109P1D4 protein shown in FIG. 2 or FIG. 3. An analog is an example of a variant protein. Splice isoforms and single nucleotides polymorphisms (SNPs) are further examples of variants.

The "109P1D4-related proteins" of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different 109P1D4 proteins or fragments thereof, as well as fusion proteins of a 109P1D4 protein and a heterologous polypeptide are also included. Such 109P1D4 proteins are collectively referred to as the 109P1D4-related proteins, the proteins of the invention, or 109P1D4. The term "109P1D4-related protein" refers to a polypeptide fragment or a 109P1D4 protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, or 576 or more amino acids.

II.) 109P1D4 Polynucleotides

One aspect of the invention provides polynucleotides corresponding or complementary to all or part of a 109P1D4 gene, mRNA, and/or coding sequence, preferably in isolated form, including polynucleotides encoding a 109P1D4-related protein and fragments thereof, DNA, RNA, DNA/RNA hybrid, and related molecules, polynucleotides or oligonucleotides complementary to a 109P1D4 gene or mRNA sequence or a part thereof, and polynucleotides or oligonucleotides that hybridize to a 109P1D4 gene, mRNA, or to a 109P1D4 encoding polynucleotide (collectively, "109P1D4 polynucleotides"). In all instances when referred to in this section, T can also be U in FIG. 2.

Embodiments of a 109P1D4 polynucleotide include: a 109P1D4 polynucleotide having the sequence shown in FIG. 2, the nucleotide sequence of 109P1D4 as shown in FIG. 2 wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of 109P1D4 nucleotides comprise, without limitation:

(I) a polynucleotide comprising, consisting essentially of, or consisting of a sequence as shown in FIG. 2, wherein T can also be U;

(II) a polynucleotide comprising, consisting essentially of, or consisting of the sequence as shown in FIG. 2A, from nucleotide residue number 846 through nucleotide residue number 3911, including the stop codon, wherein T can also be U;

(III) a polynucleotide comprising, consisting essentially of, or consisting of the sequence as shown in FIG. 2B, from nucleotide residue number 503 through nucleotide residue number 3667, including the stop codon, wherein T can also be U;

(IV) a polynucleotide comprising, consisting essentially of, or consisting of the sequence as shown in FIG. 2C, from nucleotide residue number 846 through nucleotide residue number 4889, including the a stop codon, wherein T can also be U;

(V) a polynucleotide comprising, consisting essentially of, or consisting of the sequence as shown in FIG. 2D, from nucleotide residue number 846 through nucleotide residue number 4859, including the stop codon, wherein T can also be U;

(VI) a polynucleotide comprising, consisting essentially of, or consisting of the sequence as shown in FIG. 2E, from nucleotide residue number 846 through nucleotide residue number 4778, including the stop codon, wherein T can also be U;

(VII) a polynucleotide comprising, consisting essentially of, or consisting of the sequence as shown in FIG. 2F, from nucleotide residue number 614 through nucleotide residue number 3727, including the stop codon, wherein T can also be U;

(VIII) a polynucleotide comprising, consisting essentially of, or consisting of the sequence as shown in FIG. 2G, from nucleotide residue number 735 through nucleotide residue number 3881, including the stop codon, wherein T can also be U;

(IX) a polynucleotide comprising, consisting essentially of, or consisting of the sequence as shown in FIG. 2H, from nucleotide residue number 735 through nucleotide residue number 4757, including the stop codon, wherein T can also be U;

(X) a polynucleotide comprising, consisting essentially of, or consisting of the sequence as shown in FIG. 2I, from nucleotide residue number 514 through nucleotide residue number 3627, including the stop codon, wherein T can also be U;

(XI) a polynucleotide that encodes a 109P1D4-related protein that is at least 90, 91, 92, 93, 94, 95, 96, 97, 98, 99 or 100% homologous to an entire amino acid sequence shown in FIG. 2A-I;

(XII) a polynucleotide that encodes a 109P1D4-related protein that is at least 90, 91, 92, 93, 94, 95, 96, 97, 98, 99 or 100% identical to an entire amino acid sequence shown in FIG. 2A-I;

(XIII) a polynucleotide that encodes at least one peptide set forth in Tables VIII-XXI and XXII-XLIX;

(XIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 1021 that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 1021 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 1021 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 1021 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 1021 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3B, 3C, and/or 3D in any whole number increment up to 1054, 1347, and/or 1337 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3B, 3C, and/or 3D in any whole number increment up to 1054, 1347, and/or 1337 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3B, 3C, and or 3D in any whole number increment up to 1054, 1347, and/or 1337 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXII) a polynucleotide that encodes peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3B, 3C, and/or 3D in any whole number increment up to 1054, 1347, and/or 1337 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3B, 3C, and/or 3D in any whole number increment up to 1054, 1347, and/or 1337 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E, 3F, 3G, 3H and/or 3I in any whole number increment up to 1310, 1037, 1048, 1340, and/or 1037 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XXV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E, 3F, 3G, 3H and/or 3I in any whole number increment up to 1310, 1037, 1048, 1340, and/or 1037 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E, 3F, 3G, 3H and/or 3I in any whole number increment up to 1310, 1037, 1048, 1340, and/or 1037 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E, 3F, 3G, 3H and/or 3I in any whole number increment up to 1310, 1037, 1048, 1340, and/or 1037 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3E, 3F, 3G, 3H, and/or 3I in any whole number increment up to 1310, 1037, 1048, 1340, and/or 1037 respectively that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXIX) a polynucleotide that is fully complementary to a polynucleotide of any one of (I)-(XXVIII);

(XXX) a polynucleotide that is fully complementary to a polynucleotide of any one of (I)-(XXIX);

(XXXI) a peptide that is encoded by any of (I) to (XXX); and;

(XXXII) a composition comprising a polynucleotide of any of (I)-(XXX) or peptide of (XXXI) together with a pharmaceutical excipient and/or in a human unit dose form;

(XXXIII) a method of using a polynucleotide of any (I)-(XXX) or peptide of (XXXI) or a composition of (XXXII) in a method to modulate a cell expressing 109P1D4;

(XXXIV) a method of using a polynucleotide of any (I)-(XXX) or peptide of (XXXI) or a composition of (XXXII) in a method to diagnose, prophylax, prognose, or treat an individual who bears a cell expressing 109P1D4;

(XXXV) a method of using a polynucleotide of any (I)-(XXX) or peptide of (XXXI) or a composition of (XXXII) in a method to diagnose, prophylax, prognose, or treat an individual who bears a cell expressing 109P1D4, said cell from a cancer of a tissue listed in Table I;

(XXXVI) a method of using a polynucleotide of any (I)-(XXX) or peptide of (XXXI) or a composition of (XXXII) in a method to diagnose, prophylax, prognose, or treat a a cancer;

(XXXVII) a method of using a polynucleotide of any (I)-(XXX) or peptide of (XXXI) or a composition of (XXXII) in a method to diagnose, prophylax, prognose, or treat a a cancer of a tissue listed in Table I; and;

(XXXVIII) a method of using a polynucleotide of any (I)-(XXX) or peptide of (XXXI) or a composition of (XXXII) in a method to identify or characterize a modulator of a cell expressing 109P1D4.

As used herein, a range is understood to disclose specifically all whole unit positions thereof.

Typical embodiments of the invention disclosed herein include 109P1D4 polynucleotides that encode specific portions of 109P1D4 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1010, 1020, and 1021 or more contiguous amino acids of 109P1D4 variant 1; the maximal lengths relevant for other variants are: variant 2, 1054 amino acids; variant 3, 1347 amino acids, variant 4, 1337 amino acids, variant 5, 1310 amino acids, variant 6; 1047 amino acids, variant 7; 1048 amino acids, variant 8; 1340 amino adds and variant 9; 1037 amoni acids.

For example, representative embodiments of the invention disclosed herein include: polynucdeotides and their encoded peptides themselves encoding about amino acid 1 to about amino acid 10 of the 109P1D4 protein shown in FIG. 2 or FIG. 3, polynucleotides encoding about amino acid 10 to about amino acid 20 of the 109P1D4 protein shown in FIG. 2 or FIG. 3, polynucleotides encoding about amino acid 20 to about amino acid 30 of the 109P1D4 protein shown in FIG. 2 or FIG. 3, polynucleotides encoding about amino acid 30 to about amino acid 40 of the 109P1D4 protein shown in FIG. 2 or FIG. 3, polynucleotides encoding about amino acid 40 to about amino acid 50 of the 109P1D4 protein shown in FIG. 2 or FIG. 3, polynucleotides encoding about amino acid 50 to about amino acid 60 of the 109P1D4 protein shown in FIG. 2 or FIG. 3, polynucleotides encoding about amino acid 60 to about amino acid 70 of the 109P1D4 protein shown in FIG. 2 or FIG. 3, polynucleotides encoding about amino acid 70 to about amino acid 80 of the 109P1D4 protein shown in FIG. 2 or FIG. 3, polynucleotides encoding about amino acid 80 to about amino acid 90 of the 109P1D4 protein shown in FIG. 2 or FIG. 3, polynucleotides encoding about amino acid 90 to about amino acid 100 of the 109P1D4 protein shown in FIG. 2 or FIG. 3, in increments of about 10 amino acids, ending at the carboxyl terminal amino acid set forth in FIG. 2 or FIG. 3. Accordingly, polynucleotides encoding portions of the amino acid sequence (of about 10 amino acids), of amino acids, 100 through the carboxyl terminal amino acid of the 109P1D4 protein are embodiments of the invention. Wherein it is understood that each particular amino acid position discloses that position plus or minus five amino acid residues.

Polynucleotides encoding relatively long portions of a 109P1D4 protein are also within the scope of the invention. For example, polynucleotides encoding from about amino acid 1 (or 20 or 30 or 40 etc.) to about amino acid 20, (or 30, or 40 or 50 etc.) of the 109P1D4 protein "or variant" shown in FIG. 2 or FIG. 3 can be generated by a variety of techniques well known in the art. These polynucleotide fragments can include any portion of the 109P1D4 sequence as shown in FIG. 2.

Additional illustrative embodiments of the invention disclosed herein include 109P1D4 polynucleotide fragments encoding one or more of the biological motifs contained within a 109P1D4 protein "or variant" sequence, including one or more of the motif-bearing subsequences of a 109P1D4 protein "or variant" set forth in Tables VIII-XXI and XXII-XLIX. In another embodiment, typical polynucleotide fragments of the invention encode one or more of the regions of 109P1D4 protein or variant that exhibit homology to a known molecule. In another embodiment of the invention, typical polynucleotide fragments can encode one or more of the 109P1D4 protein or variant N-glycosylation sites, cAMP and cGMP-dependent protein kinase phosphorylation sites, casein kinase II phosphorylation sites or N-myristoylation site and amidation sites.

Note that to determine the starting position of any peptide set forth in Tables VIII-XXI and Tables XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides listed in Table VII. Generally, a unique Search Peptide is used to obtain HLA peptides for a particular variant. The position of each Search Peptide relative to its respective parent molecule is listed in Table VII. Accordingly, if a Search Peptide begins at position "X", one must add the value "X minus 1" to each position in Tables VIII-XXI and Tables XXII-IL to obtain the actual position of the HLA peptides in their parental molecule. For example if a particular Search Peptide begins at position 150 of its parental molecule, one must add 150–1, i.e., 149 to each HLA peptide amino acid position to calculate the position of that amino acid in the parent molecule.

II.A.) Uses of 109P1D4 Polynucleotides

II.A.1.) Monitoring of Genetic Abnormalities

The polynucleotides of the preceding paragraphs have a number of different specific uses. The human 109P1D4 gene maps to the chromosomal location set forth in the Example entitled "Chromosomal Mapping of 109P1D4." For example, because the 109P1D4 gene maps to this chromosome, polynucleotides that encode different regions of the 109P1D4 proteins are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(3-4): 81-83 (1998); Johansson et al., Blood 86(10): 3905-3914 (1995) and Finger et al., P.N.A.S. 85(23): 9158-9162 (1988)). Thus, polynucleotides encoding specific regions of the 109P1D4 proteins provide new tools that can be used to delineate, with greater precision than previously possible, cytogenetic abnormalities in the chromosomal region that encodes 109P1D4 that may contribute to the malignant phenotype. In this context, these polynucleotides satisfy a need in the art for expanding the sensitivity of chromosomal screening in order to identify more subtle and less common chromosomal abnormalities (see e.g. Evans et al., Am. J. Obstet. Gynecol 171(4): 1055-1057 (1994)).

Furthermore, as 109P1D4 was shown to be highly expressed in prostate and other cancers, 109P1D4 polynucleotides are used in methods assessing the status of 109P1D4 gene products in normal versus cancerous tissues Typically, polynucleotides that encode specific regions of the 109P1D4 proteins are used to assess the presence of perturbations (such as deletions, insertions, point mutations, or alterations resulting in a loss of an antigen etc.) in specific regions of the 109P1D4 gene, such as regions containing one or more motifs. Exemplary assays include both RT-PCR assays as well as single-strand conformation polymorphism (SSCP) analysis (see, e.g., Marrogi et al., J. Cutan. Pathol. 26(8): 369-378 (1999), both of which utilize polynucleotides encoding specific regions of a protein to examine these regions within the protein.

II.A.2.) Antisense Embodiments

Other specifically contemplated nucleic add related embodiments of the invention disclosed herein are genomic DNA, cDNAs, ribozymes, and antisense molecules, as well as nucleic add molecules based on an alternative backbone, or including alternative bases, whether derived from natural sources or synthesized, and include molecules capable of inhibiting the RNA or protein expression of 109P1D4. For example, antisense molecules can be RNAs or other molecules, including peptide nucleic acids (PNAs) or non-nucleic acid molecules such as phosphorothioate derivatives that specifically bind DNA or RNA in a base pair-dependent manner. A skilled artisan can readily obtain these classes of nucleic add molecules using the 109P1D4 polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., 109P1D4. See for example, Jack Cohen, Oligodeoxynucleotides, Antisense Inhibitors of Gene Expression, CRC Press, 1989; and Synthesis 1:1-5 (1988). The 109P1D4 antisense oligonucieotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See, e.g., Iyer, R. P. et al., J. Org. Chem. 55:4693-4698 (1990); and Iyer, R. P. et al., J. Am. Chem. Soc. 112:1253-1254 (1990). Additional 109P1D4 antisense oligonucleotides of the present invention include morpholino antisense oligonucleotides known in the art (see, e.g., Partridge et al., 1996, Antisense & Nucleic Acid Drug Development 6: 169-175).

The 109P1D4 antisense oligonucleotides of the present invention typically can be RNA or DNA that is complementary to and stably hybridizes with the first 100 5' codons or last 100 3' codons of a 109P1D4 genomic sequence or the corresponding mRNA. Absolute complementarity is not required, although high degrees of complementarity are preferred. Use of an oligonucleotide complementary to this region allows for the selective hybridization to 109P1D4 mRNA and not to mRNA specifying other regulatory subunits of protein kinase. In one embodiment, 109P1D4 antisense oligonucleotides of the present invention are 15 to 30-mer fragments of the antisense DNA molecule that have a sequence that hybridizes to 109P1D4 mRNA. Optionally, 109P1D4 antisense oligonucleotide is a 30-mer oligonucleotide that is complementary to a region in the first 10 5' codons or last 10 3' codons of 109P1D4. Alternatively, the antisense molecules are modified to employ ribozymes in the inhibition of 109P1D4 expression, see, e.g., L. A. Couture & D. T. Stinchcomb; Trends Genet 12: 510-515 (1996, II.A.3.) Primers and Primer Pairs Further specific embodiments of these nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a 109P1D4 polynucleotide in a sample and as a means for detecting a cell expressing a 109P1D4 protein.

Examples of such probes include polypeptides comprising all or part of the human 109P1D4 cDNA sequence shown in FIG. 2. Examples of primer pairs capable of specifically amplifying 109P1D4 mRNAs are also described in the Examples. As will be understood by the skilled artisan, a great many different primers and probes can be prepared based on the sequences provided herein and used effectively to amplify and/or detect a 109P1D4 mRNA.

The 109P1D4 polynucleotides of the invention are useful for a variety of purposes, including but not limited to their use as probes and primers for the amplification and/or detection of the 109P1D4 gene(s), mRNA(s), or fragments thereof; as reagents for the diagnosis and/or prognosis of prostate cancer and other cancers; as coding sequences capable of directing the expression of 109P1D4 polypeptides; as tools for modulating or inhibiting the expression of the 109P1D4 gene(s) and/or translation of the 109P1D4 transcript(s); and as therapeutic agents.

The present invention includes the use of any probe as described herein to identify and isolate a 109P1D4 or 109P1D4 related nucleic acid sequence from a naturally occurring source, such as humans or other mammals, as well as the isolated nucleic acid sequence per se, which would comprise all or most of the sequences found in the probe used.

II.A.4.) Isolation of 109P1D4-Encoding Nucleic Acid Molecules

The 109P1D4 cDNA sequences described herein enable the isolation of other polynucleotides encoding 109P1D4 gene product(s), as well as the isolation of polynucleotides encoding 109P1D4 gene product homologs, alternatively spliced isoforms, allelic variants, and mutant forms of a 109P1D4 gene product as well as polynucleotides that encode analogs of 109P1D4-related proteins. Various molecular cloning methods that can be employed to isolate full length cDNAs encoding a 109P1D4 gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commercially available cloning systems (e.g., Lambda ZAP Express, Stratagene). Phage clones containing 109P1D4 gene cDNAs can be identified by probing with a labeled 109P1D4 cDNA or a fragment thereof. For example, in one embodiment, a 109P1D4 cDNA (e.g., FIG. 2) or a portion thereof can be synthesized and used as a probe to retrieve overlapping and full-length cDNAs corresponding to a 109P1D4 gene. A 109P1D4 gene itself can be isolated by screening genomic DNA libraries, bacterial artificial chromosome libraries (BACs), yeast artificial chromosome libraries (YACs), and the like, with 109P1D4 DNA probes or primers.

II.A.5.) Recombinant Nucleic Acid Molecules and Host-Vector Systems

The invention also provides recombinant DNA or RNA molecules containing a 109P1D4 polynucleotide, a fragment, analog or homologue thereof, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al., 1989, supra).

The invention further provides a host-vector system comprising a recombinant DNA molecule containing a 109P1D4 polynucleotide, fragment, analog or homologue thereof within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPr1, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of 109P1D4 or a fragment, analog or homolog thereof can be used to generate 109P1D4 proteins or fragments thereof using any number of host-vector systems routinely used and widely known in the art.

A wide range of host-vector systems suitable for the expression of 109P1D4 proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11:1785). Using these expression vectors, 109P1D4 can be expressed in several prostate cancer and non-prostate cell lines, including for example 293, 293T, rat-1, NIH 3T3 and TsuPr1. The host-vector systems of the invention are useful for the production of a 109P1D4 protein or fragment thereof. Such host-vector systems can be employed to study the functional properties of 109P1D4 and 109P1D4 mutations or analogs.

Recombinant human 109P1D4 protein or an analog or homolog or fragment thereof can be produced by mammalian cells transfected with a construct encoding a 109P1D4-related nucleotide. For example, 293T cells can be transfected with an expression plasmid encoding 109P1D4 or fragment, analog or homolog thereof, a 109P1D4-related protein is expressed in the 293T cells, and the recombinant 109P1D4 protein is isolated using standard purification methods (e.g., affinity purification using anti-109P1D4 antibodies). In another embodiment, a 109P1D4 coding sequence is subcloned into the retroviral vector pSRαMSVtkneo and used to infect various mammalian cell lines, such as NIH 3T3, TsuPr1, 293 and rat-1 in order to establish 109P1D4 expressing cell lines. Various other expression systems well known in the art can also be employed. Expression constructs encoding a leader peptide joined in frame to a 109P1D4 coding sequence can be used for the generation of a secreted form of recombinant 109P1D4 protein.

As discussed herein, redundancy in the genetic code permits variation in 109P1D4 gene sequences. In particular, it is known in the art that specific host species often have specific codon preferences, and thus one can adapt the disclosed sequence as preferred for a desired host. For example, preferred analog codon sequences typically have rare codons (i.e., codons having a usage frequency of less than about 20% in known sequences of the desired host) replaced with higher frequency codons. Codon preferences for a specific species are calculated, for example, by utilizing codon usage tables available on the INTERNET such as at URL dna.affrc.go.jp/-nakamura/codon.html.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, *Mol. Cell Biol.,* 9:5073-5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662-2666, (1995) and Kozak NAR 15(20): 8125-8148 (1987)).

III.) 109P1D4-Related Proteins

Another aspect of the present invention provides 109P1D4-related proteins. Specific embodiments of 109P1D4 proteins comprise a polypeptide having all or part of the amino acid sequence of human 109P1D4 as shown in FIG. 2 or FIG. 3. Alternatively, embodiments of 109P1D4 proteins comprise variant, homolog or analog polypeptides that have alterations in the amino acid sequence of 109P1D4 shown in FIG. 2 or FIG. 3.

Embodiments of a 109P1D4 polypeptide include: a 109P1D4 polypeptide having a sequence shown in FIG. 2, a peptide sequence of a 109P1D4 as shown in FIG. 2 wherein T is U; at least 10 contiguous nucleotides of a polypeptide having the sequence as shown in FIG. 2; or, at least 10 contiguous peptides of a polypeptide having the sequence as shown in FIG. 2 where T is U. For example, embodiments of 109P1D4 peptides comprise, without limitation:

(I) a protein comprising, consisting essentially of, or consisting of an amino acid sequence as shown in FIG. 2A-I or FIG. 3A-I;

(II) a 109P1D4-related protein that is at least 90, 91, 92, 93, 94, 95, 96, 97, 98, 99 or 100% homologous to an entire amino acid sequence shown in FIG. 2A-I or 3A-I;

(III) a 109P1D4-related protein that is at least 90, 91, 92, 93, 94, 95, 96, 97, 98, 99 or 100% identical to an entire amino acid sequence shown in FIG. 2A-I or 3A-I;

(IV) a protein that comprises at least one peptide set forth in Tables VIII to XLIX, optionally with a proviso that it is not an entire protein of FIG. 2;

(V) a protein that comprises at least one peptide set forth in Tables VIII-XXI, collectively, which peptide is also set forth in Tables XXII to XLIX, collectively, optionally with a proviso that it is not an entire protein of FIG. 2;

(VI) a protein that comprises at least two peptides selected from the peptides set forth in Tables VIII-XLIX, optionally with a proviso that it is not an entire protein of FIG. 2;

(VII) a protein that comprises at least two peptides selected from the peptides set forth in Tables VIII to XLIX collectively, with a proviso that the protein is not a contiguous sequence from an amino acid sequence of FIG. 2;

(VIII) a protein that comprises at least one peptide selected from the peptides set forth in Tables VIII-XXI; and at least one peptide selected from the peptides set forth in Tables XXII to XLIX, with a proviso that the protein is not a contiguous sequence from an amino acid sequence of FIG. 2;

(IX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3B, 3C, 3D and/or 3E in any whole number increment up to 1021, 1054, 1347, 1337, and/or 1310 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(X) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3B, 3C, 3D, and/or 3E, in any whole number increment up to 1021, 1054, 1347, 1337, and/or 1310 respectively respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3B, 3C, 3D, and/or 3E, in any whole number increment up to 1021, 1054, 1347, 1337, and/or 1310 respectively respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3B, 3C, 3D, and/or 3E, in any whole number increment up to 1021, 1054, 1347, 1337, and/or 1310 respectively respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIGS. 3A, 3B, 3C, 3D, and 3E in any whole number increment up to 1021, 1054, 1347, 1337, and/or 1310 respectively respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3F, 3G, 3H, and/or 3I, in any whole number increment up to 1037, 1048, 1340, and/or 1037 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3F, 3G, 3H, and/or 3I, in any whole number increment up to 1037, 1048, 1340, and/or 1037 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XVI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3F, 3G, 3H, and/or 3I, in any whole number increment up to 1037, 1048, 1340, and/or 1037 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XVII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3F, 3G, 3H, and/or 3I in any whole number increment up to 1037, 1048, 1340, and/or 1037 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XVIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIGS. 3F, 3G, 3H, and/or 3I in any whole number increment up to 1037, 1048, 1340, and/or 1037 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIX) a peptide that occurs at least twice in Tables VIII-XXI and XXII to XLIX, collectively;

(XX) a peptide that occurs at least three times in Tables VIII-XXI and XXII to XLIX, collectively;

(XXI) a peptide that occurs at least four times in Tables VIII-XXI and XXII to XLIX, collectively;

(XXII) a peptide that occurs at least five times in Tables VIII-XXI and XXII to XLIX, collectively;

(XXIII) a peptide that occurs at least once in Tables VIII-XXI, and at least once in tables XXII to XLIX;

(XXIV) a peptide that occurs at least once in Tables VIII-XXI, and at least twice in tables XXII to XLIX;

(XXV) a peptide that occurs at least twice in Tables VII-XXI, and at least once in tables XXII to XLIX;

(XXVI) a peptide that occurs at least twice in Tables VIII-XXI, and at least twice in tables XXII to XLIX;

(XXVII) a peptide which comprises one two, three, four, or five of the following characteristics, or an oligonucleotide encoding such peptide:

i) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or, v) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9;

(XXVIII) a composition comprising a peptide of (I)-(XX-VII) or an antibody or binding region thereof together with a pharmaceutical excipient and/or in a human unit dose form.

(XXIX) a method of using a peptide of (I)-(XXVII), or an antibody or binding region thereof or a composition of (XXVIII) in a method to modulate a cell expressing 109P1D4;

(XXX) a method of using a peptide of (I)-(XXVII) or an antibody or binding region thereof or a composition of (XXVIII) in a method to diagnose, prophylax, prognose, or treat an individual who bears a cell expressing 109P1D4;

(XXXI) a method of using a peptide of (I)-(XXVII) or an antibody or binding region thereof or a composition (XXVIII) in a method to diagnose, prophylax, prognose, or treat an individual who bears a cell expressing 109P1D4, said cell from a cancer of a tissue listed in Table I;

(XXXII) a method of using a peptide of (I)-(XXVII) or an antibody or binding region thereof or a composition of (XXVIII) in a method to diagnose, prophylax, prognose, or treat a a cancer;

(XXXIII) a method of using a peptide of (I)-(XXVII) or an antibody or binding region thereof or a composition of (XXVIII) in a method to diagnose, prophylax, prognose, or treat a a cancer of a tissue listed in Table I; and;

(XXXIV) a method of using a a peptide of (I)-(XXVII) or an antibody or binding region thereof or a composition (XXVIII) in a method to identify or characterize a modulator of a cell expressing 109P1D4

As used herein, a range is understood to specifically disclose all whole unit positions thereof.

Typical embodiments of the invention disclosed herein include 109P1D4 polynucleotides that encode specific portions of 109P1D4 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1010, 1020, and 1021 or more contiguous amino acids of 109P1D4 variant 1; the maximal lengths relevant for other variants are: variant 2, 1054 amino acids; variant 3, 1347 amino acids, variant 4, 1337 amino acids, variant 5, 1310 amino acids, variant 6; 1037 amino acids, variant 7; 1048 amino acids, variant 8; 1340 amino acids, and variant 9; 1037 amino acids.

In general, naturally occurring allelic variants of human 109P1D4 share a high degree of structural identity and homology (e.g., 90% or more homology) Typically, allelic variants of a 109P1D4 protein contain conservative amino acid substitutions within the 109P1D4 sequences described herein or contain a substitution of an amino acid from a corresponding position in a homologue of 109P1D4. One class of 109P1D4 allelic variants are proteins that share a high degree of homology with at least a small region of a particular 109P1D4 amino acid sequence, but further contain a radical departure from the sequence, such as a nonconservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (Q) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table III herein; pages 13-15 "Biochemistry" 2$^{nd}$ ED. Lubert Stryer ed (Stanford University); Henikoff et al., PNAS 1992 Vol 89 10915-10919; Lei et al., J Biol Chem 1995 May 19; 270(20):11882-6).

Embodiments of the invention disclosed herein include a wide variety of art-accepted variants or analogs of 109P1D4 proteins such as polypeptides having amino acid insertions, deletions and substitutions. 109P1D4 variants can be made using methods known in the art such as site-directed mutagenesis, alanine scanning, and PCR mutagenesis. Site-directed mutagenesis (Carter et al., *Nucl. Acids Res.*, 13:4331 (1986); Zoller et al., *Nucl. Acids Res.*, 10:6487 (1987)), cassette mutagenesis (Wells et al., Gene, 34:315 (1985)), restriction selection mutagenesis (Wells et al., *Philos. Trans. R. Soc. London SerA,* 317:415 (1986)) or other known techniques can be performed on the cloned DNA to produce the 109P1D4 variant DNA.

Scanning amino acid analysis can also be employed to identify one or more amino acids along a contiguous sequence that is involved in a specific biological activity such asia protein-protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, *The Proteins*, (W.H. Freeman & Co., N.Y.); Chothia, J. Mol. Biol., 150:1 (1976)). If alanine substitution does not yield adequate amounts of variant, an isosteric amino acid can be used.

As defined herein, 109P1D4 variants, analogs or homologs, have the distinguishing attribute of having at least one epitope that is "cross reactive" with a 109P1D4 protein having an amino acid sequence of FIG. 3. As used in this sentence, "cross reactive" means that an antibody or T cell that specifically binds to a 109P1D4 variant also specifically binds to a 109P1D4 protein having an amino acid sequence set forth in FIG. 3. A polypeptide ceases to be a variant of a protein shown in FIG. 3, when it no longer contains any epitope capable of being recognized by an antibody or T cell that specifically binds to the starting 109P1D4 protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165(12): 6949-6955; Hebbes et al., Mol Immunol (1989) 26(9):865-73; Schwartz et al., J Immunol (1985) 135(4):2598-608.

Other classes of 109P1D4-related protein variants share 70%, 75%, 80%, 85% or 90% or more similarity with an amino acid sequence of FIG. 3, or a fragment thereof. Another specific class of 109P1D4 protein variants or analogs comprises one or more of the 109P1D4 biological motifs described herein or presently known in the art. Thus, encompassed by the present invention are analogs of 109P1D4 fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of a 109P1D4 protein shown in FIG. 2 or FIG. 3. For example, representative embodiments of the invention comprise peptides/proteins having any 4, 5, 6, 7, 8, 9, 10, 11, 12, 13, 14, 15 or more contiguous amino acids of a 109P1D4 protein shown in FIG. 2 or FIG. 3.

Moreover, representative embodiments of the invention disclosed herein include polypeptides consisting of about amino acid 1 to about amino acid 10 of a 109P1D4 protein shown in FIG. 2 or FIG. 3, polypeptides consisting of about amino acid 10 to about amino acid 20 of a 109P1D4 protein shown in FIG. 2 or FIG. 3, polypeptides consisting of about amino acid 20 to about amino acid 30 of a 109P1D4 protein shown in FIG. 2 or FIG. 3, polypeptides consisting of about amino acid 30 to about amino acid 40 of a 109P1D4 protein shown in FIG. 2 or FIG. 3, polypeptides consisting of about amino acid 40 to about amino acid 50 of a 109P1D4 protein shown in FIG. 2 or FIG. 3, polypeptides consisting of about amino acid 50 to about amino acid 60 of a 109P1D4 protein shown in FIG. 2 or FIG. 3, polypeptides consisting of about amino acid 60 to about amino acid 70 of a 109P1D4 protein shown in FIG. 2 or FIG. 3, polypeptides consisting of about amino acid 70 to about amino acid 80 of a 109P1D4 protein shown in FIG. 2 or FIG. 3, polypeptides consisting of about amino acid 80 to about amino acid 90 of a 109P1D4 protein shown in FIG. 2 or FIG. 3, polypeptides consisting of about amino acid 90 to about amino acid 100 of a 109P1D4 protein shown in FIG. 2 or FIG. 3, etc. throughout the entirety of a 109P1D4 amino acid sequence. Moreover, polypeptides consisting of about amino add 1 (or 20 or 30 or 40 etc.) to about amino acid 20, (or 130, or 140 or 150 etc.) of a 109P1D4 protein shown in FIG. 2 or FIG. 3 are embodiments of the invention. It is to be appreciated that the starting and stopping positions in this paragraph refer to the specified position as well as that position plus or minus 5 residues.

109P1D4-related proteins are generated using standard peptide synthesis technology or using chemical cleavage methods well known in the art. Alternatively, recombinant methods can be used to generate nucleic acid molecules that encode a 109P1D4-related protein. In one embodiment, nucleic acid molecules provide a means to generate defined fragments of a 109P1D4 protein (or variants, homologs or analogs thereof).

III.A.) Motif-Bearing Protein Embodiments

Additional illustrative embodiments of the invention disclosed herein include 109P1D4 polypeptides comprising the amino acid residues of one or more of the biological motifs contained within a 109P1D4 polypeptide sequence set forth in FIG. 2 or FIG. 3. Various motifs are known in the art, and a protein can be evaluated for the presence of such motifs by a number of publicly available Internet sites (see, e.g., URL addresses: pfam.wustl.edu/; searchlauncher.bcm.tmc.edu/seq-search/struc-predict.html; psort.ims.u-tokyo.ac.jp/; cbs.dtu.dk/; ebi.ac.uk/interpro/scan.html; expasy.ch/tools/scnpsit1.html; Epimatrix™ and Epimer™, Brown University, brown.edu/Research/TB-HIV_Lab/epimatrix/epimatrix htnl; and BIMAS, bimas.dcrt.nih.gov/.).

Motif bearing subsequences of all 109P1D4 variant proteins are set forth and identified in Tables VIII-XXI and XXII-XLIX.

Table V sets forth several frequently occurring motifs based on pfam searches (see URL address pfam.wustl.edu/). The columns of Table V list (1) motif name abbreviation, (2) percent identity found amongst the different member of the motif family, (3) motif name or description and (4) most common function; location information is included if the motif is relevant for location.

Polypeptides comprising one or more of the 109P1D4 motifs discussed above are useful in elucidating the specific characteristics of a malignant phenotype in view of the observation that the 109P1D4 motifs discussed above are associated with growth dysregulation and because 109P1D4 is overexpressed in certain cancers (See, e.g., Table I). Casein kinase ii, cAMP and camp-dependent protein kinase, and Protein Kinase C, for example, are enzymes known to be associated with the development of the malignant phenotype (see e.g. Chen et al., Lab Invest., 78(2): 165-174 (1998); Gaiddon et al., Endocrinology 136(10): 4331-4338(1995); Hall et al., Nucleic Acids Research 24(6): 1119-1126 (1996); Peterziel et al., Oncogene 18(46): 6322-6329 (1999) and O'Brian, Oncol. Rep. 5(2): 305-309 (1998)). Moreover, both glycosylaton and myristoylation are protein modifications also associated with cancer and cancer progression (see e.g. Dennis et al., Biochem. Biophys. Acta 1473(1):21-34 (1999); Raju et al., Exp. Cell Res. 235(1): 145-154 (1997)). Amidation is another protein modification also associated with cancer and cancer progression (see e.g. Treston et al., J. Natl. Cancer Inst. Monogr. (13): 169-175 (1992)).

In another embodiment, proteins of the invention comprise one or more of the immunoreactive epitopes identified in accordance with art-accepted methods, such as the peptides set forth in Tables VIII-XXI and XXII-XLIX. CTL epitopes can be determined using specific algorithms to identify peptides within a 109P1D4 protein that are capable of optimally binding to specified HLA alleles (e.g., Table IV; Epimatrix™ and Epimer™, Brown University, URL brown.edu/Research/TB-HIV_Lab/epimatrix/epimatrix.html; and BIMAS, URL bimas.dcrt.nih.gov/.) Moreover, processes for identifying pepbdes that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/supermotifs of Table IV). The epitope is analoged by substituting out an amino acid at one of the specified positions, and replacing it with another amino acid specified for that position. For example, on the basis of residues defined in Table IV, one can substitute out a deleterious residue in favor of any other residue, such as a preferred residue; substitute a less-preferred residue with a preferred residue; or substitute an originally occurring preferred residue with another preferred residue. Substitutions can occur at primary anchor positions or at other positions in a peptide; see, e.g., Table IV.

A variety of references reflect the art regarding the identification and generation of epitopes in a protein of interest as well as analogs thereof. See, for example, WO 97/33602 to Chesnut et al.; Sette, Immunogenetics 1999 50(3-4): 201-212; Sette et al., J. Immunol. 2001 166(2): 1389-1397; Sidney et al., Hum. Immunol. 1997 58(1): 12-20; Kondo et al., Immunogenetics 1997 45(4): 249-258; Sidney et al., J. Immunol. 1996 157(8): 3480-90; and Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)); Kast et al., 1994 152(8): 3904-12; Borras-Cuesta et al., Hum. Immunol. 2000 61(3): 266-278; Alexander et al., J. Immunol. 2000 164(3); 164(3): 1625-1633; Alexander et al., PMID: 7895164, UI: 95202582; O'Sullivan et al., J. Immunol. 1991 147(8): 2663-2669; Alexander et al., Immunity 1994 1(9): 751-761 and Alexander et al., Immunol. Res. 1998 18(2): 79-92.

Related embodiments of the invention include polypeptides comprising combinations of the different motifs set forth in Table VI, and/or, one or more of the predicted CTL epitopes of Tables VIII-XXI and XXII-XLIX, and/or, one or more of the predicted HTL epitopes of Tables XLVI-XLIX, and/or, one or more of the T cell binding motifs known in the art. Preferred embodiments contain no insertions, deletions or substitutions either within the motifs or within the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically, the number of N-terminal and/or C-terminal amino acid residues on either side of a motif is between about 1 to about 100 amino acid residues, preferably 5 to about 50 amino acid residues.

109P1D4-related proteins are embodied in many forms, preferably in isolated form. A purified 109P1D4 protein molecule will be substantially free of other proteins or molecules that impair the binding of 109P1D4 to antibody, T cell or other ligand. The nature and degree of isolation and purification will depend on the intended use. Embodiments of a 109P1D4-related proteins include purified 109P1D4-related proteins and functional, soluble 109P1D4-related proteins. In one embodiment, a functional, soluble 109P1D4 protein or fragment thereof retains the ability to be bound by antibody, T cell or other ligand.

The invention also provides 109P1D4 proteins comprising biologically active fragments of a 109P1D4 amino acid sequence shown in FIG. 2 or FIG. 3. Such proteins exhibit properties of the starting 109P1D4 protein, such as the ability to elicit the generation of antibodies that specifically bind an epitope associated with the starting 109P1D4 protein; to be bound by such antibodies; to elicit the activation of HTL or CTL; and/or, to be recognized by HTL or CTL that also specifically bind to the starting protein.

109P1D4-related polypeptides that contain particularly interesting structures can be predicted and/or identified using various analytical techniques well known in the ark including, for example, the methods of Chou-Fasman, Gamier-Robson, Kyte-Doolittle, Eisenberg, Karplus-Schultz or Jameson-Wolf analysis, or based on immunogenicity. Fragments that contain such structures are particularly useful in generating subunit-specific anti-109P1D4 antibodies or T cells or in identifying cellular factors that bind to 109P1D4. For example, hydrophilicity profiles can be generated, and immunogenic peptide fragments identified, using the method of Hopp, T. P. and Woods, K. R., 1981, Proc. Natl. Acad. Sci. U.S.A. 78:3824-3828. Hydropathicity profiles can be generated, and immunogenic peptide fragments identified, using the method of Kyte, J. and Doolittle, R. F., 1982, J. Mol. Biol. 157:105-132. Percent (%) Accessible Residues profiles can be generated, and immunogenic peptide fragments identified, using the method of Janin J., 1979, Nature 277:491-492. Average Flexibility profiles can be generated, and immunogenic peptide fragments identified, using the method of Bhaskaran R., Ponnuswamy P. K., 1988, Int. J. Pept. Protein Res. 32:242-255. Beta-turn profiles can be generated, and immunogenic peptide fragments identified, using the method of Deleage, G., Roux B., 1987, Protein Engineering 1:289-294.

CTL epitopes can be determined using specific algorithms to identify peptides within a 109P1D4 protein that are capable of optimally binding to specified HLA alleles (e.g., by using the SYFPEITHI site at World Wide Web URL syfpeithi.bmi-heidelberg.com/; the listings in Table IV(AY(E); Epimatrix™ and Epimer™, Brown University, URL (brown.edu/Research/TB-HIV_Lab/epimatix/epimatix.html); and BIMAS, URL bimas.dcrt.nih.gov/). Illustrating this, peptide epitopes from 109P1D4 that are presented in the context of human MHC Class I molecules, e.g., HLA-A1, A2, A3, A11, A24, B7 and B35 were predicted (see, e.g., Tables VIII-XXI, XXII-XLIX). Specifically, the complete amino acid sequence of the 109P1D4 protein and relevant portions of other variants, i.e., for HLA Class I predictions 9 flanking residues on either side of a point mutation or exon junction, and for HLA Class II predictions 14 flanking residues on either side of a point mutation or exon junction corresponding to that variant, were entered into the HLA Peptide Motif Search algorithm found in the Bioinformatics and Molecular Analysis Section (BIMAS) web site listed above; in addition to the site SYFPEITHI, at URL syfpeithi.bmi-heidelberg.com/.

The HLA peptide motif search algorithm was developed by Dr. Ken Parker based on binding of specific peptide sequences in the groove of HLA Class I molecules, in particular HLA-A2 (see, e.g., Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for Class I HLA-A2, the epitopes preferably contain a leucine (L) or methionine (M) at position 2 and a valine (V) or leucine (L) at the C-terminus (see, e.g., Parker et al., J. Immunol. 149: 3580-7 (1992)). Selected results of 109P1D4 predicted binding peptides are shown in Tables VIII-XXI and XXII-XLIX herein. In Tables VIII-XXI and XXII-XLVII, selected candidates, 9-mers and 10-mers, for each family member are shown along with their location, the amino acid sequence of each specific peptide, and an estimated binding score. In Tables XLVI-XLIX, selected candidates, 15-mers, for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

Actual binding of peptides to an HLA allele can be evaluated by stabilization of HLA expression on the antigen-processing defective cell line T2 (see, e.g., Xue et al., Prostate 30:73-8 (1997) and Peshwa et al., Prostate 36:129-38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table IV (or determined using World Wide Web site URL syfpeithi.bmi-heidelberg.com/, or BIMAS, bimas.dcrt.nih.gov/) are to be "applied" to a 109P1D4 protein in accordance with the invention. As used in this context "applied" means that a 109P1D4 protein is evaluated, e.g., visually or by computer-based patterns finding methods, as appreciated by those of skill in the relevant art. Every subsequence of a 109P1D4 protein of 8, 9, 10, or 11 amino acid residues that bears an HLA Class I motif, or a subsequence of 9 or more amino acid residues that bear an HLA Class II motif are within the scope of the invention.

III.B.) Expression of 109P1D4-Related Proteins

In an embodiment described in the examples that follow, 109P1D4 can be conveniently expressed in cells (such as 293T cells) transfected with a commercially available expression vector such as a CMV-driven expression vector encoding 109P1D4 with a C-terminal 6× His and MYC tag (pcDNA3.1/mycHIS, Invitrogen or Tag5, GenHunter Corporation, Nashville TN). The Tag5 vector provides an IgGK secretion signal that can be used to facilitate the production of a secreted 109P1D4 protein in transfected cells. The secreted HIS-tagged 109P1D4 in the culture media can be purified, e.g., using a nickel column using standard techniques.

III.C.) Modifications of 109P1D4-Related Proteins

Modifications of 109P1D4-related proteins such as covalent modifications are included within the scope of this invention. One type of covalent modification includes reacting targeted amino acid residues of a 109P1D4 polypeptide with an organic derivatizing agent that is capable of reacting with selected side chains or the N- or C-terminal residues of a 109P1D4 protein. Another type of covalent modification of a 109P1D4 polypeptide included within the scope of this invention comprises altering the native glycosylation pattern of a protein of the invention. Another type of covalent modification of 109P1D4 comprises linking a 109P1D4 polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The 109P1D4-related proteins of the present invention can also be modified to form a chimeric molecule comprising 109P1D4 fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of a 109P1D4 sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of 109P1D4. A chimeric molecule can comprise a fusion of a 109P1D4-related protein with a polyhistidine epitope tag, which provides an epitope to which immobilized nickel can selectively bind, with cytokines or with growth factors. The epitope tag is generally placed at the amino- or carboxyl-terminus of a 109P1D4 protein. In an alternative embodiment, the chimeric molecule can comprise a fusion of a 109P1D4-related protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a 109P1D4 polypeptide in place of at least one variable region within an Ig molecule. In a preferred embodiment, the immunoglobulin fusion includes the hinge, CH2 and CH3, or the hinge, CHl, CH2 and CH3 regions of an IgGI molecule. For the production of immunoglobulin fusions see, e.g., U.S. Pat. No. 5,428, 130 issued Jun. 27, 1995.

III.D.) Uses of 109P1D4-Related Proteins

The proteins of the invention have a number of different specific uses. As 109P1D4 is highly expressed in prostate and other cancers, 109P1D4-related proteins are used in methods that assess the status of 109P1D4 gene products in normal versus cancerous tissues, thereby elucidating the malignant phenotype. Typically, polypeptides from specific regions of a 109P1D4 protein are used to assess the presence of perturbations (such as deletions, insertions, point mutations etc.) in those regions (such as regions containing one or more motifs). Exemplary assays utilize antibodies or T cells targeting 109P1D4-related proteins comprising the amino acid residues of one or more of the biological motifs contained within a 109P1D4 polypeptide sequence in order to evaluate the characteristics of this region in normal versus cancerous tissues or to elicit an immune response to the epitope. Alternatively, 109P1D4-related proteins that contain the amino acid residues of one or more of the biological motifs in a 109P1D4 protein are used to screen for factors that interact with that region of 109P1D4.

109P1D4 protein fragments/subsequences are particularly useful in generating and characterizing domain-specific antibodies (e.g., antibodies recognizing an extracellular or intracellular epitope of a 109P1D4 protein), for identifying agents or cellular factors that bind to 109P1D4 or a particular structural domain thereof, and in various therapeutic and diagnostic contexts, including but not limited to diagnostic assays, cancer vaccines and methods of preparing such vaccines.

Proteins encoded by the 109P1D4 genes, or by analogs, homologs or fragments thereof, have a variety of uses, including but not limited to generating antibodies and in methods for identifying ligands and other agents and cellular constituents that bind to a 109P1D4 gene product. Antibodies raised against a 109P1D4 protein or fragment thereof are useful in diagnostic and prognostic assays, and imaging methodologies in the management of human cancers characterized by expression of 109P1D4 protein, such as those listed in Table I. Such antibodies can be expressed intracellularly and used in methods of treating patients with such cancers. 109P1D4-related nucleic acids or proteins are also used in generating HTL or CTL responses.

Various immunological assays useful for the detection of 109P1D4 proteins are used, including but not limited to various types of radioimmunoassays, enzyme-linked immunosorbent assays (ELISA), enzymelinked immunofluorescent assays (ELIFA), immunocytochemical methods, and the like. Antibodies can be labeled and used as immunological imaging reagents capable of detecting 109P1D4-expressing cells (e.g., in radioscintigraphic imaging methods). 109P1D4 proteins are also particularly useful in generating cancer vaccines, as further described herein.

IV.) 109P1D4 Antibodies

Another aspect of the invention provides antibodies that bind to 109P1D4-related proteins. Preferred antibodies specifically bind to a 109P1D4-related protein and do not bind (or bind weakly) to peptides or proteins that are not 109P1D4-related proteins under physiological conditions. In this context, examples of physiological conditions include: 1) phosphate buffered saline; 2) Tris-buffered saline containing 25 mM Tris and 150 mM NaCl; or normal saline (0.9% NaCl); 4) animal serum such as human serum; or, 5) a combination of any of 1) through 4), these reactions preferably taking place at pH 7.5, alternatively in a range of pH 7.0 to 8.0, or alternatively in a range of pH 6.5 to 8.5; also, these reactions taking place at a temperature between 4° C. to 37° C. For example, antibodies that bind 109P1D4 can bind 109P1D4-related proteins such as the homologs or analogs thereof.

109P1D4 antibodies of the invention are particularly useful in cancer (see, e.g., Table I) diagnostic and prognostic assays, and imaging methodologies. Similarly, such antibodies are useful in the treatment, diagnosis, and/or prognosis of other cancers, to the extent 109P1D4 is also expressed or overexpressed in these other cancers. Moreover, intracellularly expressed antibodies (e.g., single chain antibodies) are therapeutically useful in treating cancers in which the expression of 109P1D4 is involved, such as advanced or metastatic prostate cancers.

The invention also provides various immunological assays useful for the detection and quantification of 109P1D4 and mutant 109P1D4-related proteins. Such assays can comprise one or more 109P1D4 antibodies capable of recognizing and binding a 109P1D4-related protein, as appropriate. These assays are performed within various immunological assay formats well known in the art, including but not limited to various types of radioimmunoassays, enzyme-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting prostate cancer and other cancers expressing 109P1D4 are also provided by the invention, including but not limited to radioscintigraphic imaging methods using labeled 109P1D4 antibodies. Such assays are clinically useful in the detection, monitoring, and prognosis of 109P1D4 expressing cancers such as prostate cancer.

109P1D4 antibodies are also used in methods for purifying a 109P1D4-related protein and for isolating 109P1D4 homologues and related molecules. For example, a method of purifying a 109P1D4-related protein comprises incubating a 109P1D4 antibody, which has been coupled to a solid matrix, with a lysate or other solution containing a 109P1D4-related protein under conditions that permit the 109P1D4 antibody to bind to the 109P1D4-related protein; washing the solid matrix to eliminate impurities; and eluting the 109P1D4-related protein from the coupled antibody. Other uses of 109P1D4 antibodies in accordance with the invention include generating anti-idiotypic antibodies that mimic a 109P1D4 protein.

Various methods for the preparation of antibodies are well known in the art For example, antibodies can be prepared by immunizing a suitable mammalian host using a 109P1D4-related protein, peptide, or fragment, in isolated or immunoconjugated form (Antibodies: A Laboratory Manual, CSH Press, Eds., Harlow, and Lane (1988); Harlow, Antibodies, Cold Spring Harbor Press, NY (1989)). In addition, fusion proteins of 109P1D4 can also be used, such as a 109P1D4 GST-fusion protein. In a particular embodiment, a GST fusion protein comprising all or most of the amino add sequence of FIG. 2 or FIG. 3 is produced, then used as an immunogen to generate appropriate antibodies. In another embodiment, a 109P1D4-related protein is synthesized and used as an immunogen.

In addition, naked DNA immunization techniques known in the art are used (with or without purified 109P1D4-related protein or 109P1D4 expressing cells) to generate an immune response to the encoded immunogen (for review, see Donnelly et al., 1997, Ann. Rev. Immunol. 15: 617-648).

The amino add sequence of a 109P1D4 protein as shown in FIG. 2 or FIG. 3 can be analyzed to select specific regions of the 109P1D4 protein for generating antibodies. For example, hydrophobicity and hydrophilicity analyses of a 109P1D4 amino acid sequence are used to identify hydrophilic regions in the 109P1D4 structure. Regions of a 109P1D4 protein that show immunogenic structure, as well as other regions and domains, can readily be identified using various other methods known in the art, such as Chou-Fasman, Gamier-Robson, Kyte-Doolitte, Eisenberg, Karplus-Schultz or Jameson-Wolf analysis. Hydrophilicity profiles can be generated using the method of Hopp, T. P. and Woods, K. R., 1981, Proc. Natl. Acad. Sci. U.S.A. 78:3824-3828. Hydropathicity profiles can be generated using the method of Kyte, J. and Doolittle, R. F., 1982, J. Mol. Biol. 157:105-132. Percent (%) Accessible Residues profiles can be generated using the method of Janin J., 1979, Nature 277:491-492. Average Flexibility profiles can be generated using the method of Bhaskaran R., Ponnuswamy P. K., 1988, Int. J. Pept. Protein Res. 32:242-255. Beta-turn profiles can be generated using the method of Deleage, G., Roux B., 1987, Protein Engineering 1:289-294. Thus, each region identified by any of these programs or methods is within the scope of the present invention. Methods for the generation of 109P1D4 antibodies are further illustrated by way of the examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of a 109P1D4 immunogen is often conducted by injection over a suitable time period and with use of a suitable adjuvant, as is understood in the art. During the immunization schedule, titers of antibodies can be taken to determine adequacy of antibody formation.

109P1D4 monodonal antibodies can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a 109P1D4-related protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of a 109P1D4 protein can also be produced in the context of chimeric or complementarity-determining region (CDR) grafted antibodies of multiple species origin. Humanized or human 109P1D4 antibodies can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522-525; Riechmann et al., 1988, Nature 332: 323-327; Verhoeyen et al., 1988, Science 239: 1534-1536). See also, Carter et al., 1993, Proc. Natl. Acad. Sci. USA 89: 4285 and Sims et al., 1993, J. Immunol. 151:2296.

Methods for producing fully human monodonal antibodies include phage display and transgenic methods (for review, see Vaughan et al., 1998, Nature Biotechnology 16: 535-539). Fully human 109P1D4 monodonal antibodies can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45-64 (1993); Burton and Barbas, Human Antibodies from combinatorial libraries. Id., pp 65-82). Fully human 109P1D4 monodonal antibodies can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607-614; U.S. Pat. No. 6,162,963 issued 19 Dec. 2000; U.S. Pat. No. 6,150,584 issued 12 Nov. 2000; and, U.S. Pat. No. 6,114598 issued 5 Sep. 2000). This method avoids the in vitro manipulation required with phage display technology and efficiently produces high affinity authentic human antibodies.

Reactivity of 109P1D4 antibodies with a 109P1D4-related protein can be established by a number of well known means, including Western blot, immunoprecipitation, ELISA, and FACS analyses using, as appropriate, 109P1D4-related proteins, 109P1D4-expressing cells or extracts thereof. A 109P1D4 antibody or fragment thereof can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more 109P1D4 epitopes are generated using methods generally known in the art. Homodimeric antibodies can also be generated by cross-linking techniques known in the art (e.g., Wolff et al., Cancer Res. 53: 2560-2565).

V.) 109P1D4 Cellular Immune Responses

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., Cell 47:1071, 1986; Babbitt, B. P. et al., Nature 317: 359, 1985; Townsend, A. and Bodmer, H., Annu. Rev. Immunol. 7:601, 1989; Germain, R. N., Annu. Rev. Immunol. 11:403, 1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., J. Immunol. 160: 3363, 1998; Rammensee, et al., Immunogenetics 41:178, 1995; Rammensee et al., SYFPEITHI, access via World Wide Web at URL (134.2.96.221/scripts.hlaserver.dll/home.htm); Sette, A. and Sidney, J. Curr. Opin. Immunol. 10:478, 1998; Engelhard, V. H., Curr. Opin. Immunol. 6:13, 1994; Sette, A. and Grey, H. M., Curr. Opin. Immunol. 4:79, 1992; Sinigaglia, F. and Hammer, J. Curr. Biol. 6:52, 1994; Ruppert et al., Cell 74:929-937, 1993; Kondo et al., J. Immunol. 155: 4307-4312, 1995; Sidney et al., J. Immunol. 157:3480-3490, 1996; Sidney et al., Human Immunol. 45:79-93, 1996; Sette, A. and Sidney, J. Immunogenetics 1999 November; 50(3-4): 201-12, Review).

Furthermore, x-ray crystallographic analyses of HLA-peptide complexes have revealed pockets within the peptide binding deft/groove of HLA molecules which accommodate, in an allele-specific mode, residues borne by peptide ligands; these residues in turn determine the HLA binding capacity of the peptides in which they are present. (See, e.g., Madden, D. R. Annu. Rev. Immunol. 13:587, 1995; Smith, et al., Immunity 4:203, 1996; Fremont et al., Immunity 8:305, 1998; Stern et al., Structure 2:245, 1994; Jones, E. Y. Curr. Opin. Immunol. 9:75, 1997; Brown, J. H. et al., Nature 364:33, 1993; Guo, H. C. et al., Proc. Natl. Acad. Sci. USA 90:8053, 1993; Guo, H. C. et al., Nature 360:364, 1992; Silver, M. L. et al., Nature 360:367, 1992; Matsumura, M. et al., Science 257:927, 1992; Madden et al., Cell 70:1035, 1992; Fremont, D. H. et al., Science 257:919, 1992; Saper, M. A., Bjorkman, P. J. and Wiley, D. C., J. Mol. Biol. 219:277, 1991)

Accordingly, the definition of class I and class II allele-specific HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g., Wentworth, P. A. et al., Mol. Immunol. 32:603, 1995; Celis, E. et al., Proc. Natl. Acad. Sci. USA 91:2105, 1994; Tsai, V. et al., J. Immunol. 158:1796, 1997; Kawashima, I. et al., Human Immunol. 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have been either effectively vaccinated and/or from chronically ill patients (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1-2 weeks in the presence of test peptide plus antigen presenting cells (APC) to allow activation of "memory" T cells, as compared to "naive" T cells. At the end of the culture period, T cell activity is detected using assays including $^{51}$Cr release involving peptide-sensitized targets, T cell proliferation, or lymphokine release.

VI.) 109P1D4 Transgenic Animals

Nucleic acids that encode a 109P1D4-related protein can also be used to generate either transgenic animals or "knock out" animals that, in turn, are useful in the development and screening of therapeutically useful reagents. In accordance with established techniques, cDNA encoding 109P1D4 can be used to clone genomic DNA that encodes 109P1D4. The cloned genomic sequences can then be used to generate transgenic animals containing cells that express DNA that encode 109P1D4. Methods for generating transgenic animals, particularly animals such as mice or rats, have become conventional in the art and are described, for example, in U.S. Pat. Nos. 4,736,866 issued 12 Apr. 1988, and U.S. Pat. No. 4,870,009 issued 26 Sep. 1989. Typically, particular cells would be targeted for 109P1D4 transgene incorporation with tissue-specific enhancers.

Transgenic animals that include a copy of a transgene encoding 109P1D4 can be used to examine the effect of increased expression of DNA that encodes 109P1D4. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of 109P1D4 can be used to construct a 109P1D4 "knock out" animal that has a defective or altered gene encoding 109P1D4 as a result of homologous recombination between the endogenous gene encoding 109P1D4 and altered genomic DNA encoding 109P1D4 introduced into an embryonic cell of the animal. For example, cDNA that encodes 109P1D4 can be used to clone genomic DNA encoding 109P1D4 in accordance with established techniques. A portion of the genomic DNA encoding 109P1D4 can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, *Cell,* 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al., *Cell,* 69:915 (1992)). The selected cells are then injected into a blastocyst of an animal (e.g., a mouse or rat) to form aggregation chimeras (see, e.g., Bradley, in *Teratocarcinomas and Embryonic Stem Cells: A Practical Approach,* E. J. Robertson, ed. (IRL, Oxford, 1987), pp. 113-152). A chimeric embryo can then be implanted into a suitable pseudopregnant female foster animal, and the embryo brought to term to create a "knock out" animal. Progeny harboring the homologously recombined DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of a 109P1D4 polypeptide.

VII.) Methods for the Detection of 109P1D4

Another aspect of the present invention relates to methods for detecting 109P1D4 polynucleotides and 109P1D4-related proteins, as well as methods for identifying a cell that expresses 109P1D4. The expression profile of 109P1D4 makes it a diagnostic marker for metastasized disease. Accordingly, the status of 109P1D4 gene products provides information useful for predicting a variety of factors including susceptibility to advanced stage disease, rate of progression, and/or tumor aggressiveness. As discussed in detail herein, the status of 109P1D4 gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of 109P1D4 polynucleotides in a biological sample, such as serum, bone, prostate, and other tissues, urine, semen, cell preparations, and the like. Detectable 109P1D4 polynucleotides include, for example, a 109P1D4 gene or fragment thereof, 109P1D4 mRNA, alternative splice variant 109P1D4 mRNAs, and recombinant DNA or RNA molecules that contain a 109P1D4 polynucleotide. A number of methods for amplifying and/or detecting the presence of 109P1D4 polynucleotides are well known in the art and can be employed in the practice of this aspect of the invention.

In one embodiment, a method for detecting a 109P1D4 mRNA in a biological sample comprises producing cDNA from the sample by reverse transcription using at least one primer; amplifying the cDNA so produced using a 109P1D4 polynucleotides as sense and antisense primers to amplify 109P1D4 cDNAs therein; and detecting the presence of the amplified 109P1D4 cDNA. Optionally, the sequence of the amplified 109P1D4 cDNA can be determined.

In another embodiment, a method of detecting a 109P1D4 gene in a biological sample comprises first isolating genomic DNA from the sample; amplifying the isolated genomic DNA using 109P1D4 polynucleotides as sense and antisense primers; and detecting the presence of the amplified 109P1D4 gene. Any number of appropriate sense and antisense probe combinations can be designed from a 109P1D4 nucleotide sequence (see, e.g., FIG. 2) and used for this purpose.

The invention also provides assays for detecting the presence of a 109P1D4 protein in a issue or other biological sample such as serum, semen, bone, prostate, urine, cell preparations, and the like. Methods for detecting a 109P1D4-related protein are also well known and include, for example, immunoprecipitation, immunohistochemical analysis, Western blot analysis, molecular binding assays, ELISA, ELIFA and the like. For example, a method of detecting the presence of a 109P1D4-related protein in a biological sample comprises first contacting the sample with a 109P1D4 antibody, a 109P1D4-reactive fragment thereof, or a recombinant protein containing an antigen-binding region of a 109P1D4 antibody; and then detecting the binding of 109P1D4-related protein in the sample.

Methods for identifying a cell that expresses 109P1D4 are also within the scope of the invention. In one embodiment, an assay for identifying a cell that expresses a 109P1D4 gene comprises detecting the presence of 109P1D4 mRNA in the cell. Methods for the detection of particular mRNAs in cells are well known and include, for example, hybridization assays using complementary DNA probes (such as in situ hybridization using labeled 109P1D4 riboprobes, Northern blot and related techniques) and various nucleic acid amplification assays (such as RT-PCR using complementary primers specific for 109P1D4, and other amplification type detection methods, such as, for example, branched DNA, SISBA, TMA and the like). Alternatively, an assay for identifying a cell that expresses a 109P1D4 gene comprises detecting the presence of 109P1D4-related protein in the cell or secreted by the cell. Various methods for the detection of proteins are well known in the art and are employed for the detection of 109P1D4-related proteins and cells that express 109P1D4-related proteins.

109P1D4 expression analysis is also useful as a tool for identifying and evaluating agents that modulate 109P1D4 gene expression. For example, 109P1D4 expression is significantly upregulated in prostate cancer, and is expressed in cancers of the issues listed in Table I. Identification of a molecule or biological agent that inhibits 109P1D4 expression or over-expression in cancer cells is of therapeutic value. For example, such an agent can be identified by using a screen that quantifies 109P1D4 expression by RT-PCR, nucleic acid hybridization or antibody binding.

VIII.) Methods for Monitoring the Status of 109P1D4-Related Genes and their Products Oncogenesis is known to be a multistep process where cellular growth becomes progressively dysregulated and cells progress from a normal physiological state to precancerous and then cancerous states (see, e.g., Alers et al., Lab Invest. 77(5): 437-438 (1997) and Isaacs et al., Cancer Surv. 23: 19-32 (1995)). In this context, examining a biological sample for evidence of dysregulated cell growth (such as aberrant 109P1D4 expression in cancers) allows for early detection of such aberrant physiology, before a pathologic state such as cancer has progressed to a stage that therapeutic options are more limited and or the prognosis is worse. In such examinations, the status of 109P1D4 in a biological sample of interest can be compared, for example, to the status of 109P1D4 in a corresponding normal sample (e.g. a sample from that individual or alternatively another individual that is not affected by a pathology). An alteration in the status of 109P1D4 in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec. 9; 376(2): 306-14 and U.S. Pat. No. 5,837,501) to compare 109P1D4 status in a sample.

The term "status" in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of 109P1D4 expressing cells) as well as the level, and biological activity of expressed gene products (such as 109P1D4 mRNA, polynucleotides and polypeptides). Typically, an alteration in the status of 109P1D4 comprises a change in the location of 109P1D4 and/or 109P1D4 expressing cells and/or an increase in 109P1D4 mRNA and/or protein expression.

109P1D4 status in a sample can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of a 109P1D4 gene and gene products are found, for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of 109P1D4 in a biological sample is evaluated by various methods utilized by skilled artisans including, but not limited to genomic Southern analysis (to examine, for example perturbations in a 109P1D4 gene), Northern analysis and/or PCR analysis of 109P1D4 mRNA (to examine, for example alterations in the polynucleotide sequences or expression levels of 109P1D4 mRNAs), and, Western and/or immunohistochemical analysis (to examine, for example alterations in polypeptide sequences, alterations in polypeptide localization within a sample, alterations in expression levels of 109P1D4 proteins and/or associations of 109P1D4 proteins with polypeptide binding partners). Detectable 109P1D4 polynucleotides include, for example, a 109P1D4 gene or fragment thereof, 109P1D4 mRNA, alternative splice variants, 109P1D4 mRNAs, and recombinant DNA or RNA molecules containing a 109P1D4 polynucleotide.

The expression profile of 109P1D4 makes it a diagnostic marker for local and/or metastasized disease, and provides information on the growth or oncogenic potential of a biological sample. In particular, the status of 109P1D4 provides information useful for predicting susceptibility to particular disease stages, progression, and/or tumor aggressiveness. The invention provides methods and assays for determining 109P1D4 status and diagnosing cancers that express 109P1D4, such as cancers of the tissues listed in Table I. For example, because 109P1D4 mRNA is so highly expressed in prostate and other cancers relative to normal prostate tissue, assays that evaluate the levels of 109P1D4 mRNA transcripts or proteins in a biological sample can be used to diagnose a disease associated with 109P1D4 dysregulation, and can provide prognostic information useful in defining appropriate therapeutic options.

The expression status of 109P1D4 provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of 109P1D4 in biological samples such as those from individuals suffering from, or suspected of suffering from a pathology characterized by dysregulated cellular growth, such as cancer.

As described above, the status of 109P1D4 in a biological sample can be examined by a number of well-known procedures in the art. For example, the status of 109P1D4 in a biological sample taken from a specific location in the body can be examined by evaluating the sample for the presence or absence of 109P1D4 expressing cells (e.g. those that express 109P1D4 mRNAs or proteins). This examination can provide evidence of dysregulated cellular growth, for example, when 109P1D4-expressing cells are found in a biological sample that does not normally contain such cells (such as a lymph node), because such alterations in the status of 109P1D4 in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315-317 (2000); Su et al., Semin. Surg. Oncol. 18(1): 17-28 (2000) and Freeman et al., J Urol 1995 August 154(2 Pt 1):474-8).

In one aspect, the invention provides methods for monitoring 109P1D4 gene products by determining the status of 109P1D4 gene products expressed by cells from an individual suspected of having a disease associated with dysregulated cell growth (such as hyperplasia or cancer) and then comparing the status so determined to the status of 109P1D4 gene products in a corresponding normal sample. The presence of aberrant 109P1D4 gene products in the test sample relative to the normal sample provides an indication of the presence of dysregulated cell growth within the cells of the individual.

In another aspect, the invention provides assays useful in determining the presence of cancer in an individual, comprising detecting a significant increase in 109P1D4 mRNA or protein expression in a test cell or tissue sample relative to expression levels in the corresponding normal cell or tissue. The presence of 109P1D4 mRNA can, for example, be evaluated in tissues including but not limited to those listed in Table I. The presence of significant 109P1D4 expression in any of these tissues is useful to indicate the emergence, presence and/or severity of a cancer, since the corresponding normal tissues do not express 109P1D4 mRNA or express it at lower levels.

In a related embodiment, 109P1D4 status is determined at the protein level rather than at the nucleic acid level. For example, such a method comprises determining the level of 109P1D4 protein expressed by cells in a test tissue sample and comparing the level so determined to the level of 109P1D4 expressed in a corresponding normal sample. In one embodiment, the presence of 109P1D4 protein is evaluated, for example, using immunohistochemical methods. 109P1D4 antibodies or binding partners capable of detecting 109P1D4 protein expression are used in a variety of assay formats well known in the art for this purpose.

In a further embodiment, one can evaluate the status of 109P1D4 nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369-378). For example, a mutation in the sequence of 109P1D4 may be indicative of the presence or promotion of a tumor. Such assays therefore have diagnostic and predictive value where a mutation in 109P1D4 indicates a potential loss of function or increase in tumor growth.

A wide variety of assays for observing perturbations in nucleotide and amino acid sequences are well known in the art. For example, the size and structure of nucleic acid or amino add sequences of 109P1D4 gene products are observed by the Northern, Southern, Western, PCR and DNA sequencing protocols discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952,170 issued 17 Jan. 1995).

Additionally, one can examine the methylation status of a 109P1D4 gene in a biological sample. Aberrant demethylation and/or hypermethylation of CpG islands in gene 5' regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985-1992 (1999)). In addition, this alteration is present in at least 70% of cases of high-grade prostatic intraepithelial neoplasia (PIN) (Brooks et a., Cancer Epidemiol. Biomarkers Prev., 1998, 7:531-536). In another example, expression of the LAGE-I tumor specific gene (which is not expressed in normal prostate but is expressed in 25-50% of prostate cancers) is induced by deoxy-azacytidine in lymphoblastoid cells, suggesting that tumoral expression is due to demethylation (Lethe et al., Int. J. Cancer 76(6): 903-908 (1998)). A variety of assays for examining methyation status of a gene are well known in the art For example, one can utilize, in Southern hybridization approaches, methylation-sensitive restriction enzymes that cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al eds., 1995.

Gene amplification is an additional method for assessing the status of 109P1D4. Gene amplification is measured in a sample directly, for example, by conventional Southern blotting or Northern blotting to quantitate the transcription of mRNA (Thomas, 1980, Proc. Natl. Acad. Sci. USA, 77:5201-5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carried out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect 109P1D4 expression. The presence of RT-PCR amplifiable 109P1D4 mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al., 1997, Urol. Res. 25:373-384; Ghossein et al., 1995, J. Clin. Oncol. 13:1195-2000; Heston et al., 1995, Clin. Chem. 41:1687-1688).

A further aspect of the invention is an assessment of the susceptibility that an individual has for developing cancer. In one embodiment a method for predicting susceptibility to cancer comprises detecting 109P1D4 mRNA or 109P1D4 protein in a tissue sample, its presence indicating susceptibility to cancer, wherein the degree of 109P1D4 mRNA expression correlates to the degree of susceptibility. In a specific embodiment, the presence of 109P1D4 in prostate or other tissue is examined, with the presence of 109P1D4 in the sample providing an indication of prostate cancer susceptibility (or the emergence or existence of a prostate tumor). Similarly, one can evaluate the integrity 109P1D4 nucleotide and amino acid sequences in a biological sample, in order to identify perturbations in the structure of these molecules such as insertions, deletions, substitutions and the like. The presence of one or more perturbations in 109P1D4 gene products in the sample is an indication of cancer susceptibility (or the emergence or existence of a tumor).

The invention also comprises methods for gauging tumor aggressiveness. In one embodiment, a method for gauging aggressiveness of a tumor comprises determining the level of 109P1D4 mRNA or 109P1D4 protein expressed by tumor cells, comparing the level so determined to the level of 109P1D4 mRNA or 109P1D4 protein expressed in a corresponding normal tissue taken from the same individual or a normal tissue reference sample, wherein the degree of 109P1D4 mRNA or 109P1D4 protein expression in the tumor sample relative to the normal sample indicates the degree of aggressiveness. In a specific embodiment, aggressiveness of a tumor is evaluated by determining the extent to which 109P1D4 is expressed in the tumor cells, with higher expression levels indicating more aggressive tumors. Another embodiment is the evaluation of the integrity of 109P1D4 nucleotide and amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of 109P1D4 mRNA or 109P1D4 protein expressed by cells in a sample of the tumor, comparing the level so determined to the level of 109P1D4 mRNA or 109P1D4 protein expressed in an equivalent tissue sample taken from the same individual at a different time, wherein the degree of 109P1D4 mRNA or 109P1D4 protein expression in the tumor sample over time provides information on the progression of the cancer. In a specific embodiment, the progression of a cancer is evaluated by determining 109P1D4 expression in the tumor cells over time, where increased expression over time indicates a progression of the cancer. Also, one can evaluate the integrity 109P1D4 nucleotide and amino add sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of 109P1D4 gene and 109P1D4 gene products (or perturbations in 109P1D4 gene and 109P1D4 gene products) and a factor that is associated with malignancy, as a means for diagnosing and prognosticating the status of a tissue sample. A wide variety of factors associated with malignancy can be utilized, such as the expression of genes associated with malignancy (e.g. PSA, PSCA and PSM expression for prostate cancer etc.) as well as gross cytological observations (see, e.g., Bocking et al., 1984, Anal. Quant. Cytol. 6(2):74-88; Epstein, 1995, Hum. Pathol. 26(2):223-9; Thorson et al., 1998, Mod. Pathol. 11(6):543-51; Baisden et al., 1999, Am. J. Surg. Pathol. 23(8):918-24). Methods for observing a coincidence between the expression of 109P1D4 gene and 109P1D4 gene products (or perturbations in 109P1D4 gene and 109P1D4 gene products) and another factor that is associated with malignancy are useful, for example, because the presence of a set of specific factors that coincide with disease provides information crucial for diagnosing and prognosticating the status of a issue sample.

In one embodiment, methods for observing a coincidence between the expression of 109P1D4 gene and 109P1D4 gene products (or perturbations in 109P1D4 gene and 109Pl D4 gene products) and another factor associated with malignancy entails detecting the overexpression of 109P1D4 mRNA or protein in a tissue sample, detecting the overexpression of PSA mRNA or protein in a tissue sample (or PSCA or PSM expression), and observing a coincidence of 109P1D4 mRNA or protein and PSA mRNA or protein overexpression (or PSCA or PSM expression). In a specific embodiment, the expression of 109P1D4 and PSA mRNA in prostate tissue is examined, where the coincidence of 109P1D4 and PSA mRNA overexpression in the sample indicates the existence of prostate cancer, prostate cancer susceptibility or the emergence or status of a prostate tumor.

Methods for detecting and quantifying the expression of 109P1D4 mRNA or protein are described herein, and standard nucleic acid and protein detection and quantification technologies are well known in the art. Standard methods for the detection and quantification of 109P1D4 mRNA include in situ hybridization using labeled 109P1D4 riboprobes, Northern blot and related techniques using 109P1D4 polynucleotide probes, RT-PCR analysis using primers specific for 109P1D4, and other amplification type detection methods, such as, for example, branched DNA, SISBA, TMA and the like. In a specific embodiment, semi-quantitative RT-PCR is used to detect and quantify 109P1D4 mRNA expression. Any number of primers capable of amplifying 109P1D4 can be used for this purpose, including but not limited to the various primer sets specifically described herein. In a specific embodiment, polyclonal or monodonal antibodies specifically reactive with the wild-type 109P1D4 protein can be used in an immunohistochemical assay of biopsied tissue.

IX.) Identification of Molecules that Interact with 109P1D4

The 109P1D4 protein and nucleic acid sequences disclosed herein allow a skilled artisan to identify proteins, small molecules and other agents that interact with 109P1D4, as well as pathways activated by 109P1D4 via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein-protein interactions in vivo through reconstitution of a eukaryotic transcriptional activator, see, e.g., U.S. Pat. Nos. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcotte, et al., Nature 402: 4 Nov. 1999, 83-86).

Alternatively one can screen peptide libraries to identify molecules that interact with 109P1D4 protein sequences. In such methods, peptides that bind to 109P1D4 are identified by screening libraries that encode a random or controlled collection of amino acids. Peptides encoded by the libraries are expressed as fusion proteins of bacteriophage coat proteins, the bacteriophage particles are then screened against the 109P1D4 protein(s).

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with 109P1D4 protein sequences are disclosed for example in U.S. Pat. No. 5,723,286 issued 3 Mar. 1998 and U.S. Pat. No. 5,733,731 issued 31 Mar. 1998.

Alternatively, cell lines that express 109P1D4 are used to identify protein-protein interactions mediated by 109P1D4. Such interactions can be examined using immunoprecipitation techniques (see, e.g., Hamilton B. J., et al., Biochem. Biophys. Res. Commun. 1999, 261:646-51). 109P1D4 protein can be immunoprecipitated from 109P1D4-expressing cell lines using anti-109P1D4 antibodies. Alternatively, antibodies against His-tag can be used in a cell line engineered to express fusions of 109P1D4 and a His-tag (vectors mentioned above). The immunoprecipitated complex can be examined for protein association by procedures such as Western blotting, $^{35}$S-methionine labeling of proteins, protein microsequencing, silver staining and two-dimensional gel electrophoresis.

Small molecules and ligands that interact with 109P1D4 can be identified through related embodiments of such screening assays. For example, small molecules can be identified that interfere with protein function, including molecules that interfere with 109P1D4's ability to mediate phosphorylation and de-phosphorylation, interaction with DNA or RNA molecules as an indication of regulation of cell cycles, second messenger signaling or tumorigenesis. Similarly, small molecules that modulate 109P1D4-related ion channel, protein pump, or cell communication functions are identified and used to treat patients that have a cancer that expresses 109P1D4 (see, e.g., Hille, B., Ionic Channels of Excitable Membranes $2^{nd}$ Ed., Sinauer Assoc., Sunderland, Mass., 1992). Moreover, ligands that regulate 109P1D4 function can be identified based on their ability to bind 109P1D4 and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of 109P1D4 and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators, which activate or inhibit 109P1D4.

An embodiment of this invention comprises a method of screening for a molecule that interacts with a 109P1D4 amino acid sequence shown in FIG. 2 or FIG. 3, comprising the steps of contacting a population of molecules with a 109P1D4 amino acid sequence, allowing the population of molecules and the 109P1D4 amino acid sequence to interact under conditions that facilitate an interaction, determining the presence of a molecule that interacts with the 109P1D4 amino acid sequence, and then separating molecules that do not interact with the 109P1D4 amino acid sequence from molecules that do. In a specific embodiment, the method further comprises purifying, characterizing and identifying a molecule that interacts with the 109P1D4 amino acid sequence. The identified molecule can be used to modulate a function performed by 109P1D4. In a preferred embodiment, the 109P1D4 amino acid sequence is contacted with a library of peptides.

X). Therapeutic Methods and Compositions

The identification of 109P1D4 as a protein that is normally expressed in a restricted set of tissues, but which is also expressed in cancers such as those listed in Table 1, opens a number of therapeutic approaches to the treatment of such cancers.

Of note, targeted antitumor therapies have been useful even when the targeted protein is expressed on normal tissues, even vital normal organ tissues. A vital organ is one that is necessary to sustain life, such as the heart or colon. A non-vital organ is one that can be removed whereupon the individual is still able to survive. Examples of non-vital organs are ovary, breast, and prostate.

For example, Herceptin® is an FDA approved pharmaceutical that has as its active ingredient an antibody which is immunoreactive with the protein variously known as HER2, HER2/neu, and erb-b-2. It is marketed by Genentech and has been a commercially successful antitumor agent. Herceptin sales reached almost $400 million in 2002. Herceptin is a treatment for HER2 positive metastatic breast cancer. However, the expression of HER2 is not limited to such tumors. The same protein is expressed in a number of normal tissues. In particular, it is known that HER2/neu is present in normal kidney and heart, thus these tissues are present in all human recipients of Herceptin. The presence of HER2/neu in normal kidney is also confirmed by Latif, Z., et al., *B. J. U. International* (2002) 89:5-9. As shown in this article (which evaluated whether renal cell carcinoma should be a preferred indication for anti-HER2 antibodies such as Herceptin) both protein and mRNA are produced in benign renal tissues. Notably, HER2/neu protein was strongly overexpressed in benign renal tissue. Despite the fact that HER2/neu is expressed in such vital tissues as heart and kidney, Herceptin is a very useful, FDA approved, and commercially successful drug. The effect of Herceptin on cardiac tissue, i.e., "cardiotoxicity," has merely been a side effect to treatment. When patients were treated with Herceptin alone, significant cardiotoxicity occurred in a very low percentage of patients.

Of particular note, although kidney tissue is indicated to exhibit normal expression, possibly even higher expression than cardiac tissue, kidney has no appreciable Herceptin side effect whatsoever. Moreover, of the diverse array of normal tissues in which HER2 is expressed, there is very little occurrence of any side effect. Only cardiac tissue has manifested any appreciable side effect at all. A tissue such as kidney, where HER2Jneu expression is especially notable, has not been the basis for any side effect.

Furthermore, favorable therapeutic effects have been found for antitumor therapies that target epidermal growth factor receptor (EGFR). EGFR is also expressed in numerous normal tissues. There have been very limited side effects in normal tissues following use of anti-EGFR therapeutics.

Thus, expression of a target protein in normal tissue, even vital normal tissue, does not defeat the utility of a targeting agent for the protein as a therapeutic for certain tumors in which the protein is also overexpressed.

Accordingly, therapeutic approaches that inhibit the activity of a 109P1D4 protein are useful for patients suffering from a cancer that expresses 109P1D4. These therapeutic approaches generally fall into two classes. One class comprises various methods for inhibiting the binding or association of a 109P1D4 protein with its binding partner or with other proteins. Another class comprises a variety of methods for inhibiting the transcription of a 109P1D4 gene or translation of 109P1D4 mRNA.

X.A.) Anti-Cancer Vaccines

The invention provides cancer vaccines comprising a 109P1D4-related protein or 109P1D4-related nucleic acid. In view of the expression of 109P1D4, cancer vaccines prevent and/or treat 109P1D4-expressing cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231-237; Fong et al., 1997, J. Immunol. 159:3113-3117).

Such methods can be readily practiced by employing a 109P1D4-related protein, or a 109P1D4-encoding nucleic acid molecule and recombinant vectors capable of expressing and presenting the 109P1D4 immunogen (which typically comprises a number of antibody or T cell epitopes). Skilled artisans understand that a wide variety of vaccine systems for delivery of immunoreactive epitopes are known in the art (see, e.g., Heryln et al., Ann Med 1999 February 31(1):66-78; Maruyama et al., Cancer Immunol Immunother 2000 June 49(3):123-32) Briefly, such methods of generating an immune response (e.g. humoral and/or cell-mediated) in a mammal, comprise the steps of: exposing the mammal's immune system to an immunoreactive epitope (e.g. an epitope present in a 109P1D4 protein shown in FIG. 3 or analog or homolog thereof) so that the mammal generates an immune response that is specific for that epitope (e.g. generates antibodies that specifically recognize that epitope). In a preferred method, a 109P1D4 immunogen contains a biological motif, see e.g., Tables VIII-XXI and XXII-XLIX, or a peptide of a size range from 109P1D4 indicated in FIG. 5, FIG. 6, FIG. 7, FIG. 8, and FIG. 9.

The entire 109P1D4 protein, immunogenic regions or epitopes thereof can be combined and delivered by various means. Such vaccine compositions can include, for example, lipopeptides (e.g.,Vitiello, A. et al., *J. Clin. Invest.* 95:341, 1995), peptide compositions encapsulated in poly(DL-lactide-co-glycolide) ("PLG") microspheres (see, e.g., Eldridge, et al., *Molec. Immunol.* 28:287-294, 1991: Alonso et al., *Vaccine* 12:299-306, 1994; Jones et al., *Vaccine* 13:675-681, 1995), peptide compositions contained in immune stimulating complexes (ISCOMS) (see, e.g., Takahashi et al., *Nature* 344:873-875, 1990; Hu et al., *Clin Exp Immunol.* 113:235-243, 1998), multiple antigen peptide systems (MAPs) (see e.g., Tam, J. P., *Proc. Natl. Acad. Sci. U.S.A.* 85:5409-5413, 1988; Tam, J. P., *J. Immunol. Methods* 196:17-32, 1996), peptides formulated as multivalent peptides; peptides for use in ballistic delivery systems, typically crystallized peptides, viral delivery vectors (Perkus, M. E. et al., In: *Concepts in vaccine development*, Kaufmann, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis.* 124:148, 1971; Chanda, P. K. et al., *Virology* 175:535, 1990), particles of viral or synthetic origin (e.g., Kofler, N. et al., *J. Immunol. Methods.* 192:25, 1996; Eldridge, J. H. et al., *Sem. Hematol.* 30:16, 1993; Falo, L. D., Jr. et al., *Nature Med.* 7:649, 1995), adjuvants (Warren, H. S., Vogel, F. R., and Chedid, L. A. *Annu. Rev. Immunol.* 4:369, 1986; Gupta, R. K. et al., *Vaccine* 11:293, 1993), liposomes (Reddy, R. et al., *J. Immunol.* 148: 1585, 1992; Rock, K. L., *Immunol. Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: *Concepts in vaccine development*, Kaufmann, S. H. E., ed., p. 423, 1996; Cease, K. B., and Berzofsky, J. A.,*Annu. Rev. Immunol.* 12:923, 1994 and Eldridge, J. H. et al., *Sem. Hematol.* 30:16, 1993). Toxin-targeted delivery technologies, also known as receptor mediated targeting, such as those of Avant Immunotherapeutics, Inc. (Needham, Mass.) may also be used.

In patients with 109P1D4-associated cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

Cellular Vaccines:

CTL epitopes can be determined using specific algorithms to identify peptides within 109P1D4 protein that bind corresponding HLA alleles (see e.g., Table IV; Epimer™ and Epimatix™, Brown University (URL brown.edu/Research/TB-HIV_Lab/epimatix/epimatrix.html); and, BIMAS, (URL bimas.dcrt.nih.gov/; SYFPEITHI at URL syfpeithi.bmi-heidelberg.com/). In a preferred embodiment, a 109P1D4 immunogen contains one or more amino acid sequences identified using techniques well known in the art, such as the sequences shown in Tables VIII-XXI and XXII-XLIX or a peptide of 8, 9, 10 or 11 amino acids specified by an HLA Class I motif/supermofif (e.g., Table IV (A), Table IV (D), or Table IV (E)) and/or a peptide of at least 9 amino acids that comprises an HLA Class II motf/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule. Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

Antibody-Based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. a 109P1D4 protein) so that an immune response is generated. A typical embodiment consists of a method for generating an immune response to 109P1D4 in a host, by contacting the host with a sufficient amount of at least one 109P1D4 B cell or cytotoxic T-cell epitope or analog thereof; and at least one periodic interval thereafter re-contacting the host with the 109P1D4 B cell or cytotoxic T-cell epitope or analog thereof. A specific embodiment consists of a method of generating an immune response against a 109P1D4-related protein or a man-made multiepitopic peptide comprising: administering 109P1D4 immunogen (e.g. a 109P1D4 protein or a peptide fragment thereof, a 109P1D4 fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al., J. Immunol. 2000 164(3); 164(3): 1625-1633; Alexander et al., Immunity 1994 1(9): 751-761 and Alexander et al., Immunol. Res. 1998 18(2): 79-92). An alternative method comprises generating an immune response in an individual against a 109P1D4 immunogen by: administering in vivo to muscle or skin of the individual's body a DNA molecule that comprises a DNA sequence that encodes a 109P1D4 immunogen, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered. In addition, an antiidiotypic antibody can be administered that mimics 109P1D4, in order to generate a response to the target antigen.

Nucleic Acid Vaccines:

Vaccine compositions of the invention include nucleic acid-mediated modalities. DNA or RNA that encode protein(s) of the invention can be administered to a patient. Genetic immunization methods can be employed to generate prophylactic or therapeutic humoral and cellular immune responses directed against cancer cells expressing 109P1D4. Constructs comprising DNA encoding a 109P1D4-related protein/immunogen and appropriate regulatory sequences can be injected directly into muscle or skin of an individual, such that the cells of the muscle or skin take-up the construct and express the encoded 109P1D4 protein/immunogen. Alternatively, a vaccine comprises a 109P1D4-related protein. Expression of the 109P1D4-related protein immunogen results in the generation of prophylactic or therapeutic humoral and cellular immunity against cells that bear a 109P1D4 protein. Various prophylactic and therapeutic genetic immunization techniques known in the art can be used (for review, see information and references published at Internet address genweb.com). Nucleic acid-based delivery is described, for instance, in Wolff et. al., Science 247:1465 (1990) as well as U.S. Pat. Nos. 5,580,859; 5,589,466; 5,804,566; 5,739,118; 5,736,524; 5,679,647; WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentivirus, and sindbis virus (see, e.g., Restifo, 1996, Curr. Opin. Immunol. 8:658-663; Tsang et al. J. Natl. Cancer Inst. 87:982-990 (1995)). Non-viral delivery systems can also be employed by introducing naked DNA encoding a 109P1D4-related protein into the patient (e.g., intramuscularly or intradermally) to induce an antumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., Nature 351:456-460 (1991). A wide variety of other vectors useful for therapeutic administration or immunization of the peptides of the invention, e.g. adeno and adeno-associated virus vectors, retroviral vectors, Salmonella typhi vectors, detoxified anthrax toxin vectors, and the like, will be apparent to those skilled in the art from the description herein.

Thus, gene delivery systems are used to deliver a 109P1D4-related nucleic acid molecule. In one embodiment, the full-length human 109P1D4 cDNA is employed. In another embodiment, 109P1D4 nucleic acid molecules encoding specific cytotoxic T lymphocyte (CTL) and/or antibody epitopes are employed.

Ex Vivo Vaccines

Various ex vivo strategies can also be employed to generate an immune response. One approach involves the use of antigen presenting cells (APCs) such as dendritic cells (DC) to present 109P1D4 antigen to a patent's immune system. Dendritic cells express MHC class I and II molecules, B7 co-stimulator, and IL-12, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65-69; Murphy et al., 1996, Prostate 29:371-380). Thus, dendritic cells can be used to present 109P1D4 peptides to T cells in the context of MHC class I or II molecules. In one embodiment, autologous dendritic cells are pulsed with 109P1D4 peptides capable of binding to MHC class I and/or class II molecules. In another embodiment, dendritc cells are pulsed with the complete 109P1D4 protein. Yet another embodiment involves engineering the overexpression of a 109P1D4 gene in dendritic cells using various implementing vectors known in the art, such as adenovirus (Arthur et al., 1997, Cancer Gene Ther. 4:17-25), retrovirus (Henderson et al., 1996, Cancer Res. 56:3763-3770), lentivirus, adeno-associated virus, DNA transfection (Ribas et al., 1997, Cancer Res. 57:2865-2869), or tumor-derived RNA transfection (Ashley et al., 1997, J. Exp. Med. 186: 1177-1182). Cells that express 109P1D4 can also be engineered to express immune modulators, such as GM-CSF, and used as immunizing agents.

X.B.) 109P1D4 as a Target for Antibody-Based Therapy

109P1D4 is an attractive target for antibody-based therapeutic strategies. A number of antibody strategies are known in the art for targeting both extracellular and intracellular molecules (see, e.g., complement and ADCC mediated killing as well as the use of intrabodies). Because 109P1D4 is expressed by cancer cells of various lineages relative to corresponding normal cells, systemic administration of 109P1D4-immunoreactive compositions are prepared that exhibit excellent sensitivity without toxic, non-specific and/or non-target effects caused by binding of the immunoreactive composition to non-target organs and tissues. Antibodies specifically reactive with domains of 109P1D4 are useful to treat 109P1D4-expressing cancers systemically, either as conjugates with a toxin or therapeutic agent, or as naked antibodies capable of inhibiting cell proliferation or function.

109P1D4 antibodies can be introduced into a patient such that the antibody binds to 109P1D4 and modulates a function, such as an interaction with a binding partner, and consequently mediates destruction of the tumor cells and/or inhibits the growth of the tumor cells. Mechanisms by which such antibodies exert a therapeutic effect can include complement-mediated cytolysis, antibody-dependent cellular cytotoxicity, modulation of the physiological function of 109P1D4, inhibition of ligand binding or signal transduction pathways, modulation of tumor cell differentiation, alteration of tumor angiogenesis factor profiles, and/or apoptosis.

Those skilled in the art understand that antibodies can be used to specifically target and bind immunogenic molecules such as an immunogenic region of a 109P1D4 sequence shown in FIG. 2 or FIG. 3. In addition, skilled artisans understand that it is routine to conjugate antibodies to cytotoxic agents (see, e.g., Slevers et al., Blood 93:11 3678-3684 (Jun. 1, 1999)). When cytotoxic and/or therapeutic agents are delivered directly to cells, such as by conjugating them to antibodies specific for a molecule expressed by that cell (e.g. 109P1D4), the cytotoxic agent will exert its known biological effect (i.e. cytotoxicity) on those cells.

A wide variety of compositions and methods for using antibody-cytotoxic agent conjugates to kill cells are known in the art. In the context of cancers, typical methods entail administering to an animal having a tumor a biologically effective amount of a conjugate comprising a selected cytotoxic and/or therapeutic agent linked to a targeting agent (e.g. an anti-109P1D4 antibody) that binds to a marker (e.g. 109P1D4) expressed, accessible to binding or localized on the cell surfaces. A typical embodiment is a method of delivering a cytotoxic and/or therapeutic agent to a cell expressing 109P1D4, comprising conjugating the cytotoxic agent to an antibody that immunospecifically binds to a 109P1D4 epitope, and, exposing the cell to the antibody-agent conjugate. Another illustrative embodiment is a method of treating an individual suspected of suffering from metastasized cancer, comprising a step of administering parenterally to said individual a pharmaceutical composition comprising a therapeutically effective amount of an antibody conjugated to a cytotoxic and/or therapeutic agent.

Cancer immunotherapy using anti-109P1D4 antibodies can be done in accordance with various approaches that have been successfully employed in the treatment of other types of cancer, including but not limited to colon cancer (Arlen et al., 1998, Crit. Rev. Immunol. 18:133-138), multiple myeloma (Ozaki et al., 1997, Blood 90:3179-3186, Tsunenari et al., 1997, Blood 90:2437-2444), gastric cancer (Kasprzyk et al., 1992, Cancer Res. 52:2771-2776), B-cell lymphoma (Funakoshi et al., 1996, J. Immunother. Emphasis Tumor Immunol. 19:93-101), leukemia (Zhong et al., 1996, Leuk. Res. 20:581-589), colorectal cancer (Moun et al., 1994, Cancer Res. 54:6160-6166; Velders et al., 1995, Cancer Res. 55:4398-4403), and breast cancer (Shepard et al., 1991, J. Clin. Immunol. 11:117-127). Some therapeutic approaches involve conjugation of naked antibody to a toxin or radioisotope, such as the conjugation of $Y^{91}$ or $I^{131}$ to anti-CD20 antibodies (e.g., Zevalin™, IDEC Pharmaceuticals Corp. or Bexxar™, Coulter Pharmaceuticals), while others involve co-administration of antibodies and other therapeutic agents, such as Herceptin™ (trastuzumab) with paclitaxel (Genentech, Inc.). The antibodies can be conjugated to a therapeutic agent. To treat prostate cancer, for example, 109P1D4 antibodies can be administered in conjunction with radiation, chemotherapy or hormone ablation. Also, antibodies can be conjugated to a toxin such as calicheamicin (e.g., Mylotarg™, Wyeth-Ayerst, Madison, N.J., a recombinant humanized $IgG_4$ kappa antibody conjugated to antitumor antibiotic calicheamicin) or a maytansinoid (e.g., taxane-based Tumor-Activated Prodrug, TAP, platform, ImmunoGen, Cambridge, Mass., also see e.g., U.S. Pat. No. 5,416,064).

Although 109P1D4 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well. Fan et al. (Cancer Res. 53:4637-4642, 1993), Prewett et al. (International J. of Onco. 9:217-224, 1996), and Hancock et al. (Cancer Res. 51:4575-4580, 1991) describe the use of various antibodies together with chemotherapeutic agents.

Although 109P1D4 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well.

Cancer patients can be evaluated for the presence and level of 109P1D4 expression, preferably using immunohistochemical assessments of tumor tissue, quantitative 109P1D4 imaging, or other techniques that reliably indicate the presence and degree of 109P1D4 expression. Immunohistochemical analysis of tumor biopsies or surgical specimens is preferred for this purpose. Methods for immunohistochemical analysis of tumor tissues are well known in the art.

Anti-109P1D4 monoclonal antibodies that treat prostate and other cancers include those that initiate a potent immune response against the tumor or those that are directly cytotoxic. In this regard, anti-109P1D4 monoclonal antibodies (mAbs) can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, anti-109P1D4 mAbs that exert a direct biological effect on tumor growth are useful to treat cancers that express 109P1D4. Mechanisms by which directly cytotoxic mAbs act include: inhibition of cell growth, modulation of cellular differentiation, modulation of tumor angiogenesis factor profiles, and the induction of apoptosis. The mechanism(s) by which a particular anti-109P1D4 mAb exerts an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target 109P1D4 antigen with high affinity but exhibit low or no antigenicity in the patient.

Therapeutic methods of the invention contemplate the administration of single anti-109P1D4 mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, anti-109P1D4 mAbs can be administered concomitantly with other therapeutic modalities, including but not limited to various chemotherapeutic agents, androgen-blockers, immune modulators (e.g., IL-2, GM-CSF), surgery or radiation. The anti-109P1D4 mAbs are administered in their "naked" or unconjugated form, or can have a therapeutic agent(s) conjugated to them.

Anti-109P1D4 antibody formulations are administered via any route capable of delivering the antibodies to a tumor cell. Routes of administration include, but are not limited to, intravenous, intraperitoneal, intramuscular, intratumor, intradermal, and the like. Treatment generally involves repeated administration of the anti-109P1D4 antibody preparation, via an acceptable route of administration such as intravenous injection (IV), typically at a dose in the range of about 0.1, 0.2, 0.3, 0.4, 0.5, 0.6, 0.7, 0.8, 0.9., 1, 2, 3, 4, 5, 6, 7, 8, 9, 10, 15, 20, or 25 mg/kg body weight. In general, doses in the range of 10-1000 mg mAb per week are effective and well tolerated.

Based on clinical experience with the Herceptin™ mAb in the treatment of metastatic breast cancer, an initial loading dose of approximately 4 mg/kg patient body weight IV, followed by weekly doses of about 2 mg/kg IV of the anti-109P1D4 mAb preparation represents an acceptable dosing regimen. Preferably, the initial loading dose is administered as a 90-minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of 109P1D4 expression in the patient, the extent of circulating shed 109P1D4 antigen, the desired steady-state antibody concentration level, frequency of treatment, and the influence of chemotherapeutic or other agents used in combination with the treatment method of the invention, as well as the health status of a particular patient.

Optionally, patients should be evaluated for the levels of 109P1D4 in a given sample (e.g. the levels of circulating 109P1D4 antigen and/or 109P1D4 expressing cells) in order to assist in the determination of the most effective dosing regimen, etc. Such evaluations are also used for monitoring purposes throughout therapy, and are useful to gauge therapeutic success in combination with the evaluation of other parameters (for example, urine cytology and/or ImmunoCyt levels in bladder cancer therapy, or by analogy, serum PSA levels in prostate cancer therapy).

Anti-idiotypic anti-109P1D4 antibodies can also be used in anti-cancer therapy as a vaccine for inducing an immune response to cells expressing a 109P1D4-related protein. In particular, the generation of anti-idiotypic antibodies is well known in the art; this methodology can readily be adapted to generate anti-idiotypic anti-109P1D4 antibodies that mimic an epitope on a 109P1D4-related protein (see, for example, Wagner et al., 1997, Hybridoma 16: 33-40; Foon et al., 1995, J. Clin. Invest. 96:334-342; Herlyn et al., 1996, Cancer Immunol. Immunother. 43:65-76). Such an anti-idiotypic antibody can be used in cancer vaccine strategies.

X.C.) 109P1D4 as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine ($P_3CSS$). Moreover, an adjuvant such as a synthetic cytosine-phosphorothiolated-guanine-containing (CpG) oligonucleotides has been found to increase CTL responses 10- to 100-fold. (see, e.g. Davila and Celis, J. Immunol. 165:539-547 (2000))

Upon immunization with a pepbde composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress 109P1D4 antigen, or derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritc cell mobilization and harvesting, whereby loading of dendritic cells occurs in vitro. For example, dendritc cells are transfected, e.g., with a minigene in accordance with the invention, or are pulsed with peptides, The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic adds such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3-4 epitopes that come from at least one tumor associated antigen (TAA). For HLA Class II a similar rationale is employed; again 34 epitopes are selected from at least one TAA (see, e.g., Rosenberg et al., *Science* 278:1447-1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., *J. Immunol.* 162:3915-3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif- and/or motif-bearing epitopes derived 109P1D4, the PADRE® universal helper T cell epitope or multiple HTL epitopes from 109P1D4 (see e.g., Tables VIII-XXI and XXII to XLIX), and an endoplasmic reticulum-translocating signal sequence can be engineered. A vaccine may also comprise epitopes that are derived from other TMs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30-100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRET™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in *E. coli*, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, *Bio Techniques* 6(7): 682 (1988); U.S. Pat No. 5,279,833; WO 91/06309; and Felgner, et al., *Proc. Nat'l Acad. Sci. USA* 84:7413 (1987). In addition, peptides and compounds referred to collectively as protective, interactive, non-condensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as tetanus toxoid at positions 830-843 QYIKANSKFIGITE; (SEQ ID NO: 40), Plasmodium falciparum circumsporozoite (CS) protein at positions 378-398 DIEKKIAKMEKASS-VFNWNS; (SEQ ID NO: 41), and Streptococcus 18 kD protein at positions 116-131 GAVDSILGGVATYGM; (SEQ ID NO: 42). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed, most preferably, to bind most HLA-DR (human HLA class II) molecules. For instance, a pan-DR-binding epitope peptide having the formula: xKXVAAWTLKAAx (SEQ ID NO: 43), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the ε- and α-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to ε- and α-amino groups of Lys, which is attached via linkage, e.g., Ser-Ser, to the amino terminus of the immunogenic peptide.

As another example of lipid priming of CTL responses, E. coli lipoproteins, such as tripalmitoyl-S-glycerylcysteinly-seryl-serine ($P_3CSS$) can be used to prime virus specific CTL when covalently attached to an appropriate peptide (see, e.g., Deres, et al., Nature 342:561, 1989). Peptides of the invention can be coupled to $P_3CSS$, for example, and the lipopeptide administered to an individual to prime specifically an immune response to the target antigen. Moreover, because the induction of neutralizing antibodies can also be primed with $P_3CSS$-conjugated epitopes, two such compositions can be combined to more effectively elicit both humoral and cell-mediated responses.

X.C.4. Vaccine Compositions Comprising DC Pulsed with CTL and/or HTL Peptides

An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to 109P1D4. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses 109P1D4.

X.D. Adoptive Immunotherapy

Antigenic 109P1D4-related peptides are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7-28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E. Administration of Vaccines for Therapeutic or Prophylactic Purposes

Pharmaceutical and vaccine compositions of the invention are typically used to treat and/or prevent a cancer that expresses or overexpresses 109P1D4. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses 109P1D4. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of 109P1D4-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses 109P1D4, a vaccine comprising 109P1D4-specific CTL may be more efficacious in killing tumor cells in patient with advanced disease than alternative embodiments.

It is generally important to provide an amount of the peptide epitope delivered by a mode of administration sufficient to stimulate effectively a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 µg and the higher value is about 10,000; 20,000; 30,000; or 50,000 µg. Dosage values for a human typically range from about 500 µg to about 50,000 µg per 70 kilogram patient. Boosting dosages of between about 1.0 µg to about 50,000 µg of peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 µg and the higher value is about 10,000; 20,000; 30,000; or 50,000 µg. Dosage values for a human typically range from about 500 µg to about 50,000 µg per 70 kilogram patient. This is followed by boosting dosages of between about 1.0 µg to about 50,000 µg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, welling agents, preservatives, and the like, for example, sodium acetate, sodium lactate, sodium chloride, potassium chloride, calcium chloride, sorbitan monolaurate, tiethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., Remington's Pharmaceutical Sciences, $17^{th}$ Edition, A. Gennaro, Editor, Mack Publishing Co., Easton, Pa., 1985). For example a peptide dose for initial immunization can be from about 1 to about 50,000 µg, generally 100-5,000 µg, for a 70 kg patient. For example, for nucleic acids an initial immunization may be performed using an expression vector in the form of naked nucleic acid administered IM (or SC or ID) in the amounts of 0.5-5 mg at multiple sites. The nucleic acid (0.1 to 1000 µg) can also be administered using a gene gun. Following an incubation period of 3-4 weeks, a booster dose is then administered. The booster can be recombinant fowlpox virus administered at a dose of $5\text{-}10^7$ to $5\times10^9$ pfu.

For antibodies, a treatment generally involves repeated administration of the anti-109P1D4 antibody preparation, via an acceptable route of administration such as intravenous injection (IV), typically at a dose in the range of about 0.1 to about 10 mg/kg body weight. In general, doses in the range of 10-500 mg mAb per week are effective and well tolerated.

Moreover, an initial loading dose of approximately 4 mg/kg patient body weight IV, followed by weekly doses of about 2 mg/kg IV of the anti-109P1D4 mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of 109P1D4 expression in the patient, the extent of circulating shed 109P1D4 antigen, the desired steady-state concentration level, frequency of treatment, and the influence of chemotherapeutic or other agents used in combination with the treatment method of the invention, as well as the health status of a particular patient. Non-limiting preferred human unit doses are, for example, 500 μg-1 mg, 1 mg-50 mg, 50 mg-100 mg, 100 mg-200 mg, 200 mg-300 mg, 400 mg-500 mg, 500 mg-600 mg, 600 mg-700 mg, 700 mg-800 mg, 800 mg-900 mg, 900 mg-1 g, or 1 mg-700 mg. In certain embodiments, the dose is in the range of 2-5 mg/kg body. weight, e.g., with follow on weekly doses of 1-3 mg/kg; 0.5mg, 1, 2, 3, 4, 5, 6, 7, 8, 9, 10 mg/kg body weight followed, e.g., in two, three or four weeks by weekly doses; 0.5-10 mg/kg body weight, e.g., followed in two, three or four weeks by weekly doses; 225, 250, 275, 300, 325, 350, 375, 400 mg m$^2$ of body area weekly; 1-600 mg m$^2$ of body area weekly; 225-400 mg m$^2$ of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 70, 80, 90, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about $10^4$ cells to about $10^6$ cells, about $10^6$ cells to about $10^8$ cells, about $10^8$ to about $10^{11}$ cells, or about $10^8$ to about $5 \times 10^{10}$ cells. A dose may also about $10^6$ cells/m$^2$ to about $10^{10}$ cells/m$^2$, or about $10^6$ cells/m$^2$ to about $10^8$ cells/m$^2$.

Proteins(s) of the invention, and/or nucleic acids encoding the protein(s), can also be administered via liposomes, which may also serve to: 1) target the proteins(s) to a particular tissue, such as lymphoid tissue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al, *Ann. Rev. Biophys. Bioeng.* 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, immunogenic peptides are preferably supplied in finely divided form along with a surfactant and propellant. Typical percentages of peptides are about 0.01%-20% by weight, preferably about 1%-10%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%-20% by weight of the composition, preferably about 0.25-5%. The balance of the composition is ordinarily propellant. A carrier can also be included, as desired, as with, e.g., lecithin for intranasal delivery.

XI.) Diagnostic and Prognostic Embodiments of 109P1D4.

As disclosed herein, 109P1D4 polynucleotides, polypeptides, reactive cytotoxic T cells (CTL), reactive helper T cells (HTL) and anti-polypeptide antibodies are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described for example in the Example entitled "Expression analysis of 109P1D4 in normal tissues, and patient specimens").

109P1D4 can be analogized to a prostate associated antigen PSA, the archetypal marker that has been used by medical practitioners for years to identify and monitor the presence of prostate cancer (see, e.g., Merrill et al., J. Urol. 163(2): 503-5120 (2000); Polascik et al., J. Urol. Aug; 162(2):293-306 (1999) and Fortier et al., J. Nat. Cancer Inst. 91(19): 1635-1640(1999)). A variety of other diagnostic markers are also used in similar contexts including p53 and K-ras (see, e.g., Tulchinsky et al., Int J Mol Med 1999 July 4(1):99-102 and Minimoto et al, Cancer Detect Prev 2000; 24(1):1-12). Therefore, this disclosure of 109P1D4 polynucleotides and polypeptides (as well as 109P1D4 polynucleotide probes and anti-109P1D4 antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods which utilize the 109P1D4 polynucleotides, polypeptides, reactive T cells and antibodies are analogous to those methods from well-established diagnostic assays, which employ, e.g., PSA polynucleotides, polypeptides, reactive T cells and antibodies. For example, just as PSA polynucleotides are used as probes (for example in Northern analysis, see, e.g., Sharief et al, Biochem. Mol. Biol. Int. 33(3):567-74(1994)) and primers (for example in PCR analysis, see, e.g., Okegawa et al, J. Urol. 163(4): 1189-1190 (2000)) to observe the presence and/or the level of PSA mRNAs in methods of monitoring PSA overexpression or the metastasis of prostate cancers, the 109P1D4 polynucleotides described herein can be utilized in the same way to detect 109P1D4 overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al, Urology 55(4):560-3 (2000)) or the metastasis of prostate cells (see, e.g., Alanen et al, Pathol. Res. Pract. 192(3):233-7 (1996)), the 109P1D4 polypeptides described herein can be utilized to generate antibodies for use in detecting 109P1D4 overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing 109P1D4 polynucleotides and/or polypeptides can be used to provide evidence of metastasis. For example, when a biological sample from tissue that does not normally contain 109P1D4-expressing cells (lymph node) is found to contain 109P1D4-expressing cells such as the 109P1D4 expression seen in LAPC4 and LAPC9, xenografts isolated from lymph node and bone metastasis, respectively, this finding is indicative of metastasis.

Alternatively 109P1D4 polynucleotides and/or polypeptides can be used to provide evidence of cancer, for example, when cells in a biological sample that do not normally express 109P1D4 or express 109P1D4 at a different level are found to express 109P1D4 or have an increased expression of 109P1D4 (see, e.g., the 109P1D4 expression in the cancers listed in Table I and in patient samples etc. shown in the accompanying Figures). In such assays, artisans may further wish to generate supplementary evidence of metastasis by testing the biological sample for the presence of a second tissue restricted marker (in addition to 109P1D4) such as PSA, PSCA etc. (see, e.g., Alanen et al, Pathol. Res. Pract. 192(3): 233-237 (1996)).

The use of immunohistochemistry to identify the presence of a 109P1D4 polypeptide within a tissue section can indicate an altered state of certain cells within that tissue. It is well understood in the art that the ability of an antibody to localize to a polypeptide that is expressed in cancer cells is a way of diagnosing presence of disease, disease stage, progression and/or tumor aggressiveness. Such an antibody can also detect an altered distribution of the polypeptide within the cancer cells, as compared to corresponding non-malignant tissue.

The 109P1D4 polypeptide and immunogenic compositions are also useful in view of the phenomena of altered subcellular protein localization in disease states. Alteration of cells from normal to diseased state causes changes in cellular morphology and is often associated with changes in subcellular protein localization/distribution. For example, cell membrane proteins that are expressed in a polarized manner in normal cells can be altered in disease, resulting in distribution of the protein in a non-polar manner over the whole cell surface.

The phenomenon of altered subcellular protein localization in a disease state has been demonstrated with MUC1 and Her2 protein expression by use of immunohistochemical means. Normal epithelial cells have a typical apical distribution of MUC1, in addition to some supranuclear localization of the glycoprotein, whereas malignant lesions often demonstrate an apolar staining pattern (Diaz et al, The Breast Journal, 7; 40-45 (2001); Zhang et al, Clinical Cancer Research, 4; 2669-2676 (1998): Cao, et al, The Journal of Histochemistry and Cytochemistry, 45: 1547-1557 (1997)). In addition, normal breast epithelium is either negative for Her2 protein or exhibits only a basolateral distribution whereas malignant cells can express the protein over the whole cell surface (De Potter, et al, International Journal of Cancer, 44; 969-974 (1989): McCormick, et al, 117; 935-943 (2002)). Alternatively, distribution of the protein may be altered from a surface only localization to include diffuse cytoplasmic expression in the diseased state. Such an example can be seen with MUC1 (Diaz, et al, The Breast Journal, 7: 40-45 (2001)).

Alteration in the localization/distribution of a protein in the cell, as detected by immunohistochemical methods, can also provide valuable information concerning the favorability of certain treatment modalities. This last point is illustrated by a situation where a protein may be intracellular in normal tissue, but cell surface in malignant cells; the cell surface location makes the cells favorably amenable to antibody-based diagnostic and treatment regimens. When such an alteration of protein localization occurs for 109P1D4, the 109P1D4 protein and immune responses related thereto are very useful. Accordingly, the ability to determine whether alteration of subcellular protein localization occurred for 24P4C12 make the 109P1D4 protein and immune responses related thereto very useful. Use of the 109P1D4 compositions allows those skilled in the art to make important diagnostic and therapeutic decisions. Immunohistochemical reagents specific to 109P1D4 are also useful to detect metastases of tumors expressing 109P1D4 when the polypeptide appears in tissues where 109P1D4 is not normally produced.

Thus, 109P1D4 polypeptides and antibodies resulting from immune responses thereto are useful in a variety of important contexts such as diagnostic, prognostic, preventative and/or therapeutic purposes known to those skilled in the art.

Just as PSA polynucleotide fragments and polynucleotide variants are employed by skilled artisans for use in methods of monitoring PSA, 109P1D4 polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472-476, 478-480 (1998); Robertson et al, Methods Mol. Biol. 98:121-154 (1998)). An additional illustration of the use of such fragments is provided in the Example entitled "Expression analysis of 109P1D4 in normal tissues, and patient specimens," where a 109P1D4 polynucleotide fragment is used as a probe to show the expression of 109P1D4 RNAs in cancer cells. In addition, variant polynucleotide sequences are typically used as primers and probes for the corresponding mRNAs in PCR and Northern analyses (see, e.g., Sawai et al., Fetal Diagn. Ther. 1996 November-December 11(6):407-13 and Current Protocols In Molecular Biology, Volume 2, Unit 2, Frederick M. Ausubel et al eds., 1995)). Polynucleotide fragments and variants are useful in this context where they are capable of binding to a target polynucleotide sequence (e.g., a 109P1D4 polynucleotide shown in FIG. 2 or variant thereof under conditions of high stringency.

Furthermore, PSA polypeptides which contain an epitope that can be recognized by an antibody or T cell that specifically binds to that epitope are used in methods of monitoring PSA. 109P1D4 polypeptide fragments and polypeptide analogs or variants can also be used in an analogous manner. This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and U.S. Pat. No. 5,939,533). For example it may be preferable to utilize a polypeptide comprising one of the 109P1D4 biological motifs discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. a 109P1D4 polypeptide shown in FIG. 3).

As shown herein, the 109P1D4 polynucleotides and polypeptides (as well as the 109P1D4 polynucleotide probes and anti-109P1D4 antibodies or T cells used to identify the presence of these molecules) exhibit specific properties that make them useful in diagnosing cancers such as those listed in Table I. Diagnostic assays that measure the presence of 109P1D4 gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233-237 (1996)), and consequently, materials such as 109P1D4 polynucleotides and polypeptides (as well as the 109P1D4 polynucleotide probes and anti-109P1D4 antibodies used to identify the presence of these molecules) need to be employed to confirm a metastases of prostatic origin.

Finally, in addition to their use in diagnostic assays, the 109P1D4 polynucleotides disclosed herein have a number of other utilities such as their use in the identification of oncogenetic associated chromosomal abnormalities in the chromosomal region to which the 109P1D4 gene maps (see the Example entitled "Chromosomal Mapping of 109P1D4" below). Moreover, in addition to their use in diagnostic assays, the 109P1D4-related proteins and polynucleotides disclosed herein have other utilities such as their use in the forensic analysis of tissues of unknown origin (see, e.g., Takahama K Forensic Sci Int 1996 June 28;80(1-2): 63-9).

Additionally, 109P1D4-related proteins or polynucleotides of the invention can be used to treat a pathologic condition characterized by the over-expression of 109P1D4. For example, the amino acid or nucleic acid sequence of FIG. 2 or FIG. 3, or fragments of either, can be used to generate an immune response to a 109P1D4 antigen. Antibodies or other molecules that react with 109P1D4 can be used to modulate the function of this molecule, and thereby provide a therapeutic benefit.

XII.) Inhibition of 109P1D4 Protein Function

The invention includes various methods and compositions for inhibiting the binding of 109P1D4 to its binding partner or its association with other protein(s) as well as methods for inhibiting 109P1D4 function.

XII.A.) Inhibition of 109P1D4 with Intracellular Antibodies

In one approach, a recombinant vector that encodes single chain antibodies that specifically bind to 109P1D4 are introduced into 109P1D4 expressing cells via gene transfer technologies. Accordingly, the encoded single chain anti-109P1D4 antibody is expressed intracellularly, binds to 109P1D4 protein, and thereby inhibits its function. Methods for engineering such intracellular single chain antibodies are well known. Such intracellular antibodies, also known as "intrabodies", are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137-3141; Beerli et al., 1994, J. Biol. Chem. 289: 23931-23936; Deshane et al., 1994, Gene Ther. 1: 332-337).

Single chain antibodies comprise the variable domains of the heavy and light chain joined by a flexible linker polypeptide, and are expressed as a single polypeptde. Optionally, single chain antibodies are expressed as a single chain variable region fragment joined to the light chain constant region. Well-known intracellular trafficking signals are engineered into recombinant polynucleotide vectors encoding such single chain antibodies in order to target precisely the intrabody to the desired intracellular compartment. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture 109P1D4 in the nucleus, thereby preventing its activity within the nucleus. Nuclear targeting signals are engineered into such 109P1D4 intrabodies in order to achieve the desired targeting. Such 109P1D4 intrabodies are designed to bind specifically to a particular 109P1D4 domain. In another embodiment, cytosolic intrabodies that specifically bind to a 109P1D4 protein are used to prevent 109P1D4 from gaining access to the nucleus, thereby preventing it from exerting any biological activity within the nucleus (e.g., preventing 109P1D4 from forming transcription complexes with other factors)

In order to specifically direct the expression of such intrabodies to particular cells, the transcription of the intrabody is placed under the regulatory control of an appropriate tumor-specific promoter and/or enhancer. In order to target intrabody expression specifically to prostate, for example, the PSA promoter and/or promoter/enhancer can be utilized (See, for example, U.S. Pat. No. 5,919,652 issued 6 Jul. 1999).

XII.B.) Inhibition of 109P1D4 with Recombinant Proteins

In another approach, recombinant molecules bind to 109P1D4 and thereby inhibit 109P1D4 function. For example, these recombinant molecules prevent or inhibit 109P1D4 from accessing/binding to its binding partner(s) or associating with other protein(s). Such recombinant molecules can, for example, contain the reactive part(s) of a 109P1D4 specific antibody molecule. In a particular embodiment, the 109P1D4 binding domain of a 109P1D4 binding partner is engineered into a dimeric fusion protein, whereby the fusion protein comprises two 109P1D4 ligand binding domains linked to the Fc portion of a human IgG, such as human IgG1. Such IgG portion can contain, for example, the $C_H2$ and $C_H3$ domains and the hinge region, but not the $C_H1$ domain. Such dimeric fusion proteins are administered in soluble form to patients suffering from a cancer associated with the expression of 109P1D4, whereby the dimeric fusion protein specifically binds to 109P1D4 and blocks 109P1D4 interaction with a binding partner. Such dimeric fusion proteins are further combined into multimeric proteins using known antibody linking technologies.

XII.C.) Inhibition of 109P1D4 Transcription or Translation

The present invention also comprises various methods and compositions for inhibiting the transcription of the 109P1D4 gene. Similarly, the invention also provides methods and compositions for inhibiting the translation of 109P1D4 mRNA into protein.

In one approach, a method of inhibiting the transcription of the 109P1D4 gene comprises contacting the 109P1D4 gene with a 109P1D4 antisense polynucleotide. In another approach, a method of inhibiting 109P1D4 mRNA translation comprises contacting a 109P1D4 mRNA with an antisense polynucleotide. In another approach, a 109P1D4 specific ribozyme is used to cleave a 109P1D4 message, thereby inhibiting translation. Such antisense and ribozyme based methods can also be directed to the regulatory regions of the 109P1D4 gene, such as 109P1D4 promoter and/or enhancer elements. Similarly, proteins capable of inhibiting a 109P1D4 gene transcription factor are used to inhibit 109P1D4 mRNA transcription. The various polynucleotides and compositions useful in the aforementioned methods have been described above. The use of antisense and ribozyme molecules to inhibit transcription and translation is well known in the art.

Other factors that inhibit the transcription of 109P1D4 by interfering with 109P1D4 transcriptional activation are also useful to treat cancers expressing 109P1D4. Similarly, factors that interfere with 109P1D4 processing are useful to treat cancers that express 109P1D4. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing 109P1D4 (i.e., antisense, ribozyme, polynucleotides encoding intrabodies and other 109P1D4 inhibitory molecules). A number of gene therapy approaches are known in the art. Recombinant vectors encoding 109P1D4 antisense polynucleotides, ribozymes, factors capable of interfering with 109P1D4 transcription, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of 109P1D4 to a binding partner, etc.

In vivo, the effect of a 109P1D4 therapeutic composition can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402408). For example, PCT Patent Application WO98/16628 and U.S. Pat. No. 6,107,540 describe various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system.

Examples include, but are not limited to, any of a number of standard pharmaceutical carriers such as sterile phosphate buffered saline solutions, bacteriostatic water, and the like (see, generally, Remington's Pharmaceutical Sciences 16$^{th}$ Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) Identification, Characterization and Use of Modulators of 109P1D4

Methods to Identify and Use Modulators

In one embodiment, screening is performed to identify modulators that induce or suppress a particular expression profile, suppress or induce specific pathways, preferably generating the associated phenotype thereby. In another embodiment, having identified differentially expressed genes important in a particular state; screens are performed to identify modulators that alter expression of individual genes, either increase or decrease. In another embodiment, screening is performed to identify modulators that alter a biological function of the expression product of a differentially expressed gene. Again, having identified the importance of a gene in a particular state, screens are performed to identify agents that bind and/or modulate the biological activity of the gene product.

In addition, screens are done for genes that are induced in response to a candidate agent. After identifying a modulator (one that suppresses a cancer expression pattern leading to a normal expression pattern, or a modulator of a cancer gene that leads to expression of the gene as in normal tissue) a screen is performed to identify genes that are specifically modulated in response to the agent. Comparing expression profiles between normal tissue and agent-treated cancer tissue reveals genes that are not expressed in normal tissue or cancer tissue, but are expressed in agent treated tissue, and vice versa. These agent-specific sequences are identified and used by methods described herein for cancer genes or proteins. In particular these sequences and the proteins they encode are used in marking or identifying agent-treated cells. In addition, antibodies are raised against the agent-induced proteins and used to target novel therapeutics to the treated cancer tissue sample.

Modulator-Related Identification and Screening Assays:
Gene Expression-Related Assays Proteins, nucleic acids, and antibodies of the invention are used in screening assays. The cancer-associated proteins, antibodies, nucleic acids, modified proteins and cells containing these sequences are used in screening assays, such as evaluating the effect of drug candidates on a "gene expression profile," expression profile of polypeptides or alteration of biological function. In one embodiment, the expression profiles are used, preferably in conjunction with high throughput screening techniques to allow monitoring for expression profile genes after treatment with a candidate agent (e.g., Davis, G F, et al, J Biol Screen 7:69 (2002); Zlokarnik, et al., Science 279:84-8 (1998); Heid, Genome Res 6:986-94,1996).

The cancer proteins, antibodies, nucleic acids, modified proteins and cells containing the native or modified cancer proteins or genes are used in screening assays. That is, the present invention comprises methods for screening for compositions which modulate the cancer phenotype or a physiological function of a cancer protein of the invention. This is done on a gene itself or by evaluating the effect of drug candidates on a "gene expression profile" or biological function. In one embodiment, expression profiles are used, preferably in conjunction with high throughput screening techniques to allow monitoring after treatment with a candidate agent, see Zlokamik, supra.

A variety of assays are executed directed to the genes and proteins of the invention. Assays are run on an individual nucleic acid or protein level. That is, having identified a particular gene as up regulated in cancer, test compounds are screened for the ability to modulate gene expression or for binding to the cancer protein of the invention. "Modulation" in this context includes an increase or a decrease in gene expression. The preferred amount of modulation will depend on the original change of the gene expression in normal versus tissue undergoing cancer, with changes of at least 10%, preferably 50%, more preferably 100-300%, and in some embodiments 300-1000% or greater. Thus, if a gene exhibits a 4-fold increase in cancer tissue compared to normal tissue, a decrease of about four-fold is often desired; similarly, a 10-fold decrease in cancer tissue compared to normal tissue a target value of a 10-fold increase in expression by the test compound is often desired. Modulators that exacerbate the type of gene expression seen in cancer are also useful, e.g., as an upregulated target in further analyses.

The amount of gene expression is monitored using nucleic acid probes and the quantification of gene expression levels, or, alternatively, a gene product itself is monitored, e.g., through the use of antibodies to the cancer protein and standard immunoassays. Proteomics and separation techniques also allow for quantification of expression.

Expression Monitoring to Identify Compounds that Modify Gene Expression

In one embodiment, gene expression monitoring, i.e., an expression profile, is monitored simultaneously for a number of entities. Such profiles will typically involve one or more of the genes of FIG. 2. In this embodiment, e.g., cancer nucleic acid probes are attached to biochips to detect and quantify cancer sequences in a particular cell. Alternatively, PCR can be used. Thus, a series, e.g., wells of a microtiter plate, can be used with dispensed primers in desired wells. A PCR reaction can then be performed and analyzed for each well.

Expression monitoring is performed to identify compounds that modify the expression of one or more cancer-associated sequences, e.g., a polynucleotide sequence set out in FIG. 2. Generally, a test modulator is added to the cells prior to analysis. Moreover, screens are also provided to identify agents that modulate cancer, modulate cancer proteins of the invention, bind to a cancer protein of the invention, or interfere with the binding of a cancer protein of the invention and an antibody or other binding partner.

In one embodiment, high throughput screening methods involve providing a library containing a large number of potential therapeutic compounds (candidate compounds). Such "combinatorial chemical libraries" are then screened in one or more assays to identify those library members (particular chemical species or subclasses) that display a desired characteristic activity. The compounds thus identified can serve as conventional "lead compounds," as compounds for screening, or as therapeutics.

In certain embodiments, combinatorial libraries of potential modulators are screened for an ability to bind to a cancer polypeptide or to modulate activity. Conventionally, new chemical entities with useful properties are generated by identifying a chemical compound (called a "lead compound") with some desirable property or activity, e.g., inhibiting activity, creating variants of the lead compound, and evaluating the property and activity of those variant compounds. Often, high throughput screening (HTS) methods are employed for such an analysis.

As noted above, gene expression monitoring is conveniently used to test candidate modulators (e.g., protein, nucleic acid or small molecule). After the candidate agent has been added and the cells allowed to incubate for a period, the sample containing a target sequence to be analyzed is, e.g., added to a biochip.

If required, the target sequence is prepared using known techniques. For example, a sample is treated to lyse the cells, using known lysis buffers, electroporation, etc., with purification and/or amplification such as PCR performed as appropriate. For example, an in vitro transcription with labels covalently attached to the nucleotides is performed. Generally, the nucleic acids are labeled with biotin-FITC or PE, or with cy3 or cy5.

The target sequence can be labeled with, e.g., a fluorescent, a chemiluminescent, a chemical, or a radioactive signal, to provide a means of detecting the target sequence's specific binding to a probe. The label also can be an enzyme, such as alkaline phosphatase or horseradish peroxidase, which when provided with an appropriate substrate produces a product that is detected. Alternatively, the label is a labeled compound or small molecule, such as an enzyme inhibitor, that binds but is not catalyzed or altered by the enzyme. The label also can be a moiety or compound, such as, an epitope tag or biotin which specifically binds to streptavidin. For the example of biotin, the streptavidin is labeled as described above, thereby, providing a detectable signal for the bound target sequence. Unbound labeled streptavidin is typically removed prior to analysis.

As will be appreciated by those in the art, these assays can be direct hybridization assays or can comprise "sandwich assays", which include the use of multiple probes, as is generally outlined in U.S. Pat. Nos. 5,681,702; 5,597,909; 5,545, 730; 5,594,117; 5,591,584; 5,571,670; 5,580,731; 5,571,670; 5,591,584; 5,624,802; 5,635,352; 5,594,118; 5,359,100; 5,124, 246; and 5,681,697. In this embodiment, in general, the target nucleic acid is prepared as outlined above, and then added to the biochip comprising a plurality of nucleic acid probes, under conditions that allow the formation of a hybridization complex.

A variety of hybridization conditions are used in the present invention, including high, moderate and low stringency conditions as outlined above. The assays are generally run under stringency conditions which allow formation of the label probe hybridization complex only in the presence of target. Stringency can be controlled by altering a step parameter that is a thermodynamic variable, including, but not limited to, temperature, formamide concentration, salt concentration, chaotropic salt concentration pH, organic solvent concentration, etc. These parameters may also be used to control non-specific binding, as is generally outlined in U.S. Pat. No. 5,681,697. Thus, it can be desirable to perform certain steps at higher stringency conditions to reduce nonspecific binding.

The reactions outlined herein can be accomplished in a variety of ways. Components of the reaction can be added simultaneously, or sequentially, in different orders, with preferred embodiments outlined below. In addition, the reaction may include a variety of other reagents. These include salts, buffers, neutral proteins, e.g. albumin, detergents, etc. which can be used to facilitate optimal hybridization and detection, and/or reduce nonspecific or background interactions. Reagents that otherwise improve the efficiency of the assay, such as protease inhibitors, nuclease inhibitors, anti-microbial agents, etc., may also be used as appropriate, depending on the sample preparation methods and purity of the target. The assay data are analyzed to determine the expression levels of individual genes, and changes in expression levels as between states, forming a gene expression profile.

Biological Activity-Related Assays

The invention provides methods identify or screen for a compound that modulates the activity of a cancer-related gene or protein of the invention. The methods comprise adding a test compound, as defined above, to a cell comprising a cancer protein of the invention. The cells contain a recombinant nucleic acid that encodes a cancer protein of the invention. In another embodiment, a library of candidate agents is tested on a plurality of cells.

In one aspect, the assays are evaluated in the presence or absence or previous or subsequent exposure of physiological signals, e.g. hormones, antibodies, peptides, antigens, cytokines, growth factors, action potentials, pharmacological agents including chemotherapeutics, radiation, carcinogenics, or other cells (i.e., cell-cell contacts). In another example, the determinations are made at different stages of the cell cycle process. In this way, compounds that modulate genes or proteins of the invention are identified. Compounds with pharmacological activity are able to enhance or interfere with the activity of the cancer protein of the invention. Once identified, similar structures are evaluated to identify critical structural features of the compound.

In one embodiment, a method of modulating (e.g., inhibiting) cancer cell division is provided; the method comprises administration of a cancer modulator. In another embodiment, a method of modulating (e.g., inhibiting) cancer is provided; the method comprises administration of a cancer modulator. In a further embodiment, methods of treating cells or individuals with cancer are provided; the method comprises administration of a cancer modulator.

In one embodiment, a method for modulating the status of a cell that expresses a gene of the invention is provided. As used herein status comprises such art-accepted parameters such as growth, proliferation, survival, function, apoptosis, senescence, location, enzymatic activity, signal transduction, etc. of a cell. In one embodiment, a cancer inhibitor is an antibody as discussed above. In another embodiment, the cancer inhibitor is an antisense molecule. A variety of cell growth, proliferation, and metastasis assays are known to those of skill in the art, as described herein.

High Throughput Screening to Identify Modulators

The assays to identify suitable modulators are amenable to high throughput screening. Preferred assays thus detect enhancement or inhibition of cancer gene transcription, inhibition or enhancement of polypeptide expression, and inhibition or enhancement of polypeptide activity.

In one embodiment, modulators evaluated in high throughput screening methods are proteins, often naturally occurring proteins or fragments of naturally occurring proteins. Thus, e.g., cellular extracts containing proteins, or random or directed digests of proteinaceous cellular extracts, are used. In this way, libraries of proteins are made for screening in the methods of the invention. Particularly preferred in this embodiment are libraries of bacterial, fungal, viral, and mammalian proteins, with the latter being preferred, and human proteins being especially preferred. Particularly useful test compound will be directed to the class of proteins to which the target belongs, e.g., substrates for enzymes, or ligands and receptors.

Use of Soft Agar Growth and Colony Formation to Identify and Characterize Modulators Normal cells require a solid substrate to attach and grow. When cells are transformed, they lose this phenotype and grow detached from the substrate. For example, transformed cells can grow in stirred suspension culture or suspended in semi-solid media, such as semi-solid or soft agar. The transformed cells, when transfected with tumor suppressor genes, can regenerate normal phenotype and once again require a solid substrate to attach to and grow. Soft agar growth or colony formation in assays are used to identify modulators of cancer sequences, which when expressed in host cells, inhibit abnormal cellular proliferation and transformation. A modulator reduces or eliminates the host cells' ability to grow suspended in solid or semisolid media, such as agar.

Techniques for soft agar growth or colony formation in suspension assays are described in Freshney, Culture of Animal Cells a Manual of Basic Technique (3rd ed., 1994). See also, the methods section of Garkavtsev et al. (1996), supra.

Evaluation of Contact Inhibition and Growth Density Limitation to Identify and Characterize Modulators Normal cells typically grow in a flat and organized pattern in cell culture until they touch other cells. When the cells touch one another, they are contact inhibited and stop growing. Transformed cells, however, are not contact inhibited and continue to grow to high densities in disorganized foci. Thus, transformed cells grow to a higher saturation density than corresponding normal cells. This is detected morphologically by the formation of a disoriented monolayer of cells or cells in foci. Alternatively, labeling index with ($^3$H)-thymidine at saturation density is used to measure density limitation of growth, similarly an MTT or Alamar blue assay will reveal proliferation capacity of cells and the the ability of modulators to affect same. See Freshney (1994), supra. Transformed cells, when transfected with tumor suppressor genes, can regenerate a normal phenotype and become contact inhibited and would grow to a lower density.

In this assay, labeling index with $^3$H)-thymidine at saturation density is a preferred method of measuring density limitation of growth. Transformed host cells are transfected with a cancer-associated sequence and are grown for 24 hours at saturation density in non-limiting medium conditions. The percentage of cells labeling with ($^3$H)-thymidine is determined by incorporated cpm.

Contact independent growth is used to identify modulators of cancer sequences, which had led to abnormal cellular proliferation and transformation. A modulator reduces or eliminates contact independent growth, and returns the cells to a normal phenotype.

Evaluation of Growth Factor or Serum Dependence to Identify and Characterize Modulators Transformed cells have lower serum dependence than their normal counterparts (see, e.g., Temin, J. Natl. Cancer Inst. 37:167-175 (1966); Eagle et al., J. Exp. Med 131:836-879 (1970)); Freshney, supra. This is in part due to release of various growth factors by the transformed cells. The degree of growth factor or serum dependence of transformed host cells can be compared with that of control. For example, growth factor or serum dependence of a cell is monitored in methods to identify and characterize compounds that modulate cancer-associated sequences of the invention.

Use of Tumor-Specific Marker Levels to Identify and Characterize Modulators

Tumor cells release an increased amount of certain factors (hereinafter "tumor specific markers") than their normal counterparts. For example, plasminogen activator (PA) is released from human glioma at a higher level than from normal brain cells (see, e.g., Gullino, Angiogenesis, Tumor Vascularization, and Potential Interference with Tumor Growth, in Biological Responses in Cancer, pp. 178-184 (Mihich (ed.) 1985)). Similarly, Tumor Angiogenesis Factor (TAF) is released at a higher level in tumor cells than their normal counterparts. See, e.g., Folkman, Angiogenesis and Cancer, Sem Cancer Biol. (1992)), while bFGF is released from endothelial tumors (Ensoli, B et al).

Various techniques which measure the release of these factors are described in Freshney (1994), supra. Also, see, Unkless et al., J. Biol. Chem. 249:4295-4305 (1974); Strickland & Beers, J. Biol. Chem. 251:5694-5702 (1976); Whur et al., Br. J. Cancer 42:305 312 (1980); Gullino, Angiogenesis, Tumor Vascularization, and Potential Interference with Tumor Growth, in Biological Responses in Cancer, pp. 178-184 (Mihich (ed.) 1985); Freshney, Anticancer Res. 5:111-130 (1985). For example, tumor specific marker levels are monitored in methods to identify and characterize compounds that modulate cancer-associated sequences of the invention.

Invasiveness into Matrigel to Identify and Characterize Modulators

The degree of invasiveness into Matrigel or an extracellular matrix constituent can be used as an assay to identify and characterize compounds that modulate cancer associated sequences. Tumor cells exhibit a positive correlation between malignancy and invasiveness of cells into Matrigel or some other extracellular matrix constituent. In this assay, tumorigenic cells are typically used as host cells. Expression of a tumor suppressor gene in these host cells would decrease invasiveness of the host cells. Techniques described in Cancer Res. 1999; 59:6010; Freshney (1994), supra, can be used. Briefly, the level of invasion of host cells is measured by using filters coated with Matrigel or some other extracellular matrix constituent. Penetration into the gel, or through to the distal side of the filter, is rated as invasiveness, and rated histologically by number of cells and distance moved, or by prelabeling the cells with $^{125}$1 and counting the radioactivity on the distal side of the filter or bottom of the dish. See, e.g., Freshney (1984), supra.

Evaluation of Tumor Growth In Vivo to Identify and Characterize Modulators

Effects of cancer-associated sequences on cell growth are tested in transgenic or immune-suppressed organisms. Transgenic organisms are prepared in a variety of art-accepted ways. For example, knock-out transgenic organisms, e.g., mammals such as mice, are made, in which a cancer gene is disrupted or in which a cancer gene is inserted. Knock-out transgenic mice are made by insertion of a marker gene or other heterologous gene into the endogenous cancer gene site in the mouse genome via homologous recombination. Such mice can also be made by substituting the endogenous cancer gene with a mutated version of the cancer gene, or by mutating the endogenous cancer gene, e.g., by exposure to carcinogens.

To prepare transgenic chimeric animals, e.g., mice, a DNA construct is introduced into the nuclei of embryonic stem cells. Cells containing the newly engineered genetic lesion are injected into a host mouse embryo, which is re-implanted into a recipient female. Some of these embryos develop into chimeric mice that possess germ cells some of which are derived from the mutant cell line. Therefore, by breeding the chimeric mice it is possible to obtain a new line of mice containing the introduced genetic lesion (see, e.g., Capecchi et al., Science 244:1288 (1989)). Chimeric mice can be derived according to U.S. Pat. No. 6,365,797, issued 2 Apr. 2002; U.S. Pat. No. 6,107,540 issued 22 Aug. 2000; Hogan et al., Manipulating the Mouse Embryo: A laboratory Manual, Cold Spring Harbor Laboratory (1988) and Teratocarcinomas and Embryonic Stem Cells: A Practical Approach, Robertson, ed., IRL Press, Washington, D.C., (1987).

Alternatively, various immune-suppressed or immune-deficient host animals can be used. For example, a genetically athymic "nude" mouse (see, e.g., Giovanella et al., J. Natl. Cancer Inst. 52:921 (1974)), a SCID mouse, a thymectornized mouse, or an irradiated mouse (see, e.g., Bradley et al., Br. J. Cancer 38:263 (1978); Selby et al., Br. J. Cancer 41:52 (1980)) can be used as a host. Transplantable tumor cells (typically about $10^6$ cells) injected into isogenic hosts produce invasive tumors in a high proportion of cases, while normal cells of similar origin will not. In hosts which developed invasive tumors, cells expressing cancer-associated sequences are injected subcutaneously or orthotopically. Mice are then separated into groups, including control groups and treated experimental groups) e.g. treated with a modulator). After a suitable length of time, preferably 4-8 weeks, tumor growth is measured (e.g., by volume or by its two largest dimensions, or weight) and compared to the control. Tumors that have statistically significant reduction (using, e.g., Student's T test) are said to have inhibited growth.

In Vitro Assays to Identify and Characterize Modulators

Assays to identify compounds with modulating activity can be performed in vitro. For example, a cancer polypeptide is first contacted with a potential modulator and incubated for a suitable amount of time, e.g., from 0.5 to 48 hours. In one embodiment, the cancer polypeptide levels are determined in vitro by measuring the level of protein or mRNA. The level of protein is measured using immunoassays such as Western blotting, ELISA and the like with an antibody that selectively binds to the cancer polypeptide or a fragment thereof. For measurement of mRNA, amplification, e.g., using PCR, LCR, or hybridization assays, e. g., Northern hybridization, RNAse protection, dot blotting, are preferred. The level of protein or mRNA is detected using directly or indirectly labeled detection agents, e.g., fluorescently or radioactively labeled nucleic acids, radioactively or enzymatically labeled antibodies, and the like, as described herein.

Alternatively, a reporter gene system can be devised using a cancer protein promoter operably linked to a reporter gene such as luciferase, green fluorescent protein, CAT, or P-gal. The reporter construct is typically transfected into a cell. After treatment with a potential modulator, the amount of reporter gene transcription, translation, or activity is measured according to standard techniques known to those of skill in the art (Davis GF, supra; Gonzalez, J. & Negulescu, P. Curr. Opin. Biotechnol. 1998: 9:624).

As outlined above, in vitro screens are done on individual genes and gene products. That is, having identified a particular differentially expressed gene as important in a particular state, screening of modulators of the expression of the gene or the gene product itself is performed.

In one embodiment, screening for modulators of expression of specific gene(s) is performed. Typically, the expression of only one or a few genes is evaluated. In another embodiment, screens are designed to first find compounds that bind to differentially expressed proteins. These compounds are then evaluated for the ability to modulate differentially expressed activity. Moreover, once initial candidate compounds are identified, variants can be further screened to better evaluate structure activity relationships.

Binding Assays to Identify and Characterize Modulators

In binding assays in accordance with the invention, a purified or isolated gene product of the invention is generally used. For example, antibodies are generated to a protein of the invention, and immunoassays are run to determine the amount and/or location of protein. Alternatively, cells comprising the cancer proteins are used in the assays.

Thus, the methods comprise combining a cancer protein of the invention and a candidate compound such as a ligand, and determining the binding of the compound to the cancer protein of the invention. Preferred embodiments utilize the human cancer protein; animal models of human disease of can also be developed and used. Also, other analogous mammalian proteins also can be used as appreciated by those of skill in the art. Moreover, in some embodiments variant or derivative cancer proteins are used.

Generally, the cancer protein of the invention, or the ligand, is non-diffusibly bound to an insoluble support. The support can, e.g., be one having isolated sample receiving areas (a microtiter plate, an array, etc.). The insoluble supports can be made of any composition to which the compositions can be bound, is readily separated from soluble material, and is otherwise compatible with the overall method of screening. The surface of such supports can be solid or porous and of any convenient shape.

Examples of suitable insoluble supports include microtiter plates, arrays, membranes and beads. These are typically made of glass, plastic (e.g., polystyrene), polysaccharide, nylon, nitrocellulose, or Teflon™, etc. Microtiter plates and arrays are especially convenient because a large number of assays can be carried out simultaneously, using small amounts of reagents and samples. The particular manner of binding of the composition to the support is not crucial so long as it is compatible with the reagents and overall methods of the invention, maintains the activity of the composition and is nondiffusable. Preferred methods of binding include the use of antibodies which do not sterically block either the ligand binding site or activation sequence when attaching the protein to the support, direct binding to "sticky" or ionic supports, chemical crosslinking, the synthesis of the protein or agent on the surface, etc. Following binding of the protein or ligand/binding agent to the support, excess unbound material is removed by washing. The sample receiving areas may then be blocked through incubation with bovine serum albumin (BSA), casein or other innocuous protein or other moiety.

Once a cancer protein of the invention is bound to the support, and a test compound is added to the assay. Alternatively, the candidate binding agent is bound to the support and the cancer protein of the invention is then added. Binding agents include specific antibodies, non-natural binding agents identified in screens of chemical libraries, peptide analogs, etc.

Of particular interest are assays to identify agents that have a low toxicity for human cells. A wide variety of assays can be used for this purpose, including proliferation assays, cAMP assays, labeled in vitro protein-protein binding assays, electrophoretic mobility shift assays, immunoassays for protein binding, functional assays (phosphorylation assays, etc.) and the like.

A determination of binding of the test compound (ligand, binding agent, modulator, etc.) to a cancer protein of the invention can be done in a number of ways. The test compound can be labeled, and binding determined directly, e.g., by attaching all or a portion of the cancer protein of the invention to a solid support, adding a labeled candidate compound (e.g., a fluorescent label), washing off excess reagent, and determining whether the label is present on the solid support. Various blocking and washing steps can be utilized as appropriate.

In certain embodiments, only one of the components is labeled, e.g., a protein of the invention or ligands labeled. Alternatively, more than one component is labeled with different labels, e.g., $I^{125}$, for the proteins and a fluorophor for the compound. Proximity reagents, e.g., quenching or energy transfer reagents are also useful.

Competitive Binding to Identify and Characterize Modulators

In one embodiment, the binding of the "test compound" is determined by competitive binding assay with a "competitor." The competitor is a binding moiety that binds to the target molecule (e.g., a cancer protein of the invention). Competitors include compounds such as antibodies, peptides, binding partners, ligands, etc. Under certain circumstances, the competitive binding between the test compound and the competitor displaces the test compound. In one embodiment, the test compound is labeled. Either the test compound, the competitor, or both, is added to the protein for a time sufficient to allow binding. Incubations are performed at a temperature that facilitates optimal activity, typically between four and 40° C. Incubation periods are typically optimized, e.g., to facilitate rapid high throughput screening; typically between zero and one hour will be sufficient. Excess reagent is generally removed or washed away. The second component is then added, and the presence or absence of the labeled component is followed, to indicate binding.

In one embodiment, the competitor is added first, followed by the test compound. Displacement of the competitor is an indication that the test compound is binding to the cancer protein and thus is capable of binding to, and potentially modulating, the activity of the cancer protein. In this embodiment, either component can be labeled. Thus, e.g., if the competitor is labeled, the presence of label in the post-test compound wash solution indicates displacement by the test compound. Alternatively, if the test compound is labeled, the presence of the label on the support indicates displacement.

In an alternative embodiment, the test compound is added first, with incubation and washing, followed by the competitor. The absence of binding by the competitor indicates that the test compound binds to the cancer protein with higher affinity than the competitor. Thus, if the test compound is labeled, the presence of the label on the support, coupled with a lack of competitor binding, indicates that the test compound binds to and thus potentially modulates the cancer protein of the invention.

Accordingly, the competitive binding methods comprise differential screening to identity agents that are capable of modulating the activity of the cancer proteins of the invention. In this embodiment, the methods comprise combining a cancer protein and a competitor in a first sample. A second sample comprises a test compound, the cancer protein, and a competitor. The binding of the competitor is determined for both samples, and a change, or difference in binding between the two samples indicates the presence of an agent capable of binding to the cancer protein and potentially modulating its activity. That is, if the binding of the competitor is different in the second sample relative to the first sample, the agent is capable of binding to the cancer protein.

Alternatively, differential screening is used to identify drug candidates that bind to the native cancer protein, but cannot bind to modified cancer proteins. For example the structure of the cancer protein is modeled and used in rational drug design to synthesize agents that interact with that site, agents which generally do not bind to site-modified proteins. Moreover, such drug candidates that affect the activity of a native cancer protein are also identified by screening drugs for the ability to either enhance or reduce the activity of such proteins.

Positive controls and negative controls can be used in the assays. Preferably control and test samples are performed in at least triplicate to obtain statistically significant results. Incubation of all samples occurs for a time sufficient to allow for the binding of the agent to the protein. Following incubation, samples are washed free of non-specifically bound material and the amount of bound, generally labeled agent determined. For example, where a radiolabel is employed, the samples can be counted in a scintillation counter to determine the amount of bound compound.

A variety of other reagents can be included in the screening assays. These include reagents like salts, neutral proteins, e.g. albumin, detergents, etc. which are used to facilitate optimal protein-protein binding and/or reduce non-specific or background interactions. Also reagents that otherwise improve the efficiency of the assay, such as protease inhibitors, nuclease inhibitors, anti-microbial agents, etc., can be used. The mixture of components is added in an order that provides for the requisite binding.

Use of Polynucleotides to Down-Regulate or Inhibit a Protein of the Invention.

Polynucleotide modulators of cancer can be introduced into a cell containing the target nucleotide sequence by formation of a conjugate with a ligand-binding molecule, as described in WO 91/04753. Suitable ligand-binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell. Alternatively, a polynucleotide modulator of cancer can be introduced into a cell containing the target nucleic acid sequence, e.g., by formation of a polynucleotide-lipid complex, as described in WO 90/10448. It is understood that the use of antisense molecules or knock out and knock in models may also be used in screening assays as discussed above, in addition to methods of treatment.

Inhibitory and Antisense Nucleotides

In certain embodiments, the activity of a cancer-associated protein is down-regulated, or entirely inhibited, by the use of antisense polynucleotide or inhibitory small nuclear RNA (snRNA), i.e., a nucleic acid complementary to, and which can preferably hybridize specifically to, a coding mRNA nucleic acid sequence, e.g., a cancer protein of the invention, mRNA, or a subsequence thereof. Binding of the antisense polynucleotide to the mRNA reduces the translation and/or stability of the mRNA.

In the context of this invention, antisense polynucleotides can comprise naturally occurring nucleotides, or synthetic species formed from naturally occurring subunits or their close homologs. Antisense polynucleotides may also have altered sugar moieties or inter-sugar linkages. Exemplary among these are the phosphorothioate and other sulfur containing species which are known for use in the art. Analogs are comprised by this invention so long as they function effectively to hybridize with nucleotides of the invention. See, e.g., Isis Pharmaceuticals, Carlsbad, Calif.; Sequitor, Inc., Natick, Mass.

Such antisense polynucleotides can readily be synthesized using recombinant means, or can be synthesized in vitro. Equipment for such synthesis is sold by several vendors, including Applied Biosystems. The preparation of other oligonucleotides such as phosphorothioates and alkylated derivatives is also well known to those of skill in the art.

Antisense molecules as used herein include antisense or sense oligonucleotides. Sense oligonucleotides can, e.g., be employed to block transcription by binding to the anti-sense strand. The antisense and sense oligonucleotide comprise a single stranded nucleic acid sequence (either RNA or DNA) capable of binding to target mRNA (sense) or DNA (antisense) sequences for cancer molecules. Antisense or sense oligonucleotides, according to the present invention, comprise a fragment generally at least about 12 nucleotides, preferably from about 12 to 30 nucleotides. The ability to derive an antisense or a sense oligonucleotide, based upon a cDNA sequence encoding a given protein is described in, e.g., Stein & Cohen (Cancer Res. 48:2659 (1988 and van der Krol et al. (BioTechniques 6:958 (1988)).

Ribozymes

In addition to antisense polynucleotides, ribozymes can be used to target and inhibit transcription of cancer-associated nucleotide sequences. A ribozyme is an RNA molecule that catalytically cleaves other RNA molecules. Different kinds of ribozymes have been described, including group I ribozymes, hammerhead ribozymes, hairpin ribozymes, RNase P, and axhead ribozymes (see, e.g., Castanotto et al., Adv. in Pharmacology 25: 289-317 (1994) for a general review of the properties of different ribozymes).

The general features of hairpin ribozymes are described, e.g., in Hampel et al., Nucl. Acids Res. 18:299-304 (1990); European Patent Publication No. 0360257; U.S. Pat. No. 5,254,678. Methods of preparing are well known to those of skill in the art (see, e.g., WO 94/26877; Ojwang et al., Proc. Natl. Acad. Sci. USA 90:6340-6344 (1993); Yamada et al., Human Gene Therapy 1:39-45 (1994); Leaviff et al., Proc. Natl. Acad Sci. USA 92:699-703 (1995); Leavitt et al., Human Gene Therapy 5: 1151-120 (1994); and Yamada et al., Virology 205: 121-126 (1994)).

Use of Modulators in Phenotypic Screening

In one embodiment, a test compound is administered to a population of cancer cells, which have an associated cancer expression profile. By "administrations" or "contacting" herein is meant that the modulator is added to the cells in such a manner as to allow the modulator to act upon the cell, whether by uptake and intracellular action, or by action at the cell surface. In some embodiments, a nucleic acid encoding a proteinaceous agent (i.e., a peptide) is put into a viral construct such as an adenoviral or retroviral construct, and added to the cell, such that expression of the peptide agent is accomplished, e.g., PCT US97/01019. Regulatable gene therapy systems can also be used. Once the modulator has been administered to the cells, the cells are washed if desired and are allowed to incubate under preferably physiological conditions for some period. The cells are then harvested and a new gene expression profile is generated. Thus, e.g., cancer tissue is screened for agents that modulate, e.g., induce or suppress, the cancer phenotype. A change in at least one gene, preferably many, of the expression profile indicates that the agent has an effect on cancer activity. Similarly, altering a biological function or a signaling pathway is indicative of modulator activity. By defining such a signature for the cancer phenotype, screens for new drugs that alter the phenotype are devised. With this approach, the drug target need not be known and need not be represented in the original gene/protein expression screening platform, nor does the level of transcript for the target protein need to change. The modulator inhibiting function will serve as a surrogate marker As outlined above, screens are done to assess genes or gene products. That is, having identified a particular differentially expressed gene as important in a particular state, screening of modulators of either the expression of the gene or the gene product itself is performed.

Use of Modulators to Affect Peptides of the Invention

Measurements of cancer polypeptide activity, or of the cancer phenotype are performed using a variety of assays. For example, the effects of modulators upon the function of a cancer polypeptide(s) are measured by examining parameters described above. A physiological change that affects activity is used to assess the influence of a test compound on the polypeptides of this invention. When the functional outcomes are determined using intact cells or animals, a variety of effects can be assesses such as, in the case of a cancer associated with solid tumors, tumor growth, tumor metastasis, neovascularization, hormone release, transcriptional changes to both known and uncharacterized genetic markers (e.g., by Northern blots), changes in cell metabolism such as cell growth or pH changes, and changes in intracellular second messengers such as cGNIP.

Methods of Identifying Characterizing Cancer-Associated Sequences

Expression of various gene sequences is correlated with cancer. Accordingly, disorders based on mutant or variant cancer genes are determined. In one embodiment, the invention provides methods for identifying cells containing variant cancer genes, e.g., determining the presence of, all or part, the sequence of at least one endogenous cancer gene in a cell. This is accomplished using any number of sequencing techniques. The invention comprises methods of identifying the cancer genotype of an individual, e.g., determining all or part of the sequence of at least one gene of the invention in the individual. This is generally done in at least one tissue of the individual, e.g., a tissue set forth in Table I, and may include the evaluation of a number of tissues or different samples of the same tissue. The method may include comparing the sequence of the sequenced gene to a known cancer gene, i.e., a wild-type gene to determine the presence of family members, homologies, mutations or variants. The sequence of all or part of the gene can then be compared to the sequence of a known cancer gene to determine if any differences exist. This is done using any number of known homology programs, such as BLAST, Bestfit, etc. The presence of a difference in the sequence between the cancer gene of the patient and the known cancer gene correlates with a disease state or a propensity for a disease state, as outlined herein.

In a preferred embodiment, the cancer genes are used as probes to determine the number of copies of the cancer gene in the genome. The cancer genes are used as probes to determine the chromosomal localization of the cancer genes. Information such as chromosomal localization finds use in providing a diagnosis or prognosis in particular when chromosomal abnormalities such as translocations, and the like are identified in the cancer gene locus.

XIV.) Kits/Articles of Manufacture

For use in the laboratory, prognostic, prophylactic, diagnostic and therapeutic applications described herein, kits are within the scope of the invention. Such kits can comprise a carrier, package, or container that is compartmentalized to receive one or more containers such as vials, tubes, and the like, each of the container(s) comprising one of the separate elements to be used in the method, along with a label or insert comprising instructions for use, such as a use described herein. For example, the container(s) can comprise a probe that is or can be detectably labeled. Such probe can be an antibody or polynucleotide specific for a protein or a gene or message of the invention, respectively. Where the method utilizes nucleic acid hybridization to detect the target nucleic acid, the kit can also have containers containing nucleotide(s) for amplification of the target nucleic acid sequence. Kits can comprise a container comprising a reporter, such as a biotin-binding protein, such as avidin or streptavidin, bound to a reporter molecule, such as an enzymatic, fluorescent, or radioisotope label; such a reporter can be used with, e.g., a nucleic acid or antibody. The kit can include all or part of the amino acid sequences in FIG. 2 or FIG. 3 or analogs thereof, or a nucleic acid molecule that encodes such amino acid sequences.

The kit of the invention will typically comprise the container described above and one or more other containers associated therewith that comprise materials desirable from a commercial and user standpoint, including buffers, diluents, filters, needles, syringes; carrier, package, container, vial and/or tube labels listing contents and/or instructions for use, and package inserts with instructions for use.

A label can be present on or with the container to indicate that the composition is used for a specific therapy or non-therapeutic application, such as a prognostic, prophylactic, diagnostic or laboratory application, and can also indicate directions for either in vivo or in vitro use, such as those described herein. Directions and or other information can also be included on an insert(s) or label(s) which is included with or on the kit The label can be on or associated with the container. A label a can be on a container when letters, numbers or other characters forming the label are molded or etched into the container itself; a label can be associated with a container when it is present within a receptacle or carrier that also holds the container, e.g., as a package insert. The label can indicate that the composition is used for diagnosing, treating, prophylaxing or prognosing a condition, such as a neoplasia of a tissue set forth in Table I.

The terms "kit" and "article of manufacture" can be used as synonyms.

In another embodiment of the invention, an article(s) of manufacture containing compositions, such as amino acid sequence(s), small molecule(s), nucleic acid sequence(s), and/or antibody(s), e.g., materials useful for the diagnosis, prognosis, prophylaxis and/or treatment of neoplasias of tissues such as those set forth in Table I is provided. The article of manufacture typically comprises at least one container and at least one label. Suitable containers include, for example, bottles, vials, syringes, and test tubes. The containers can be formed from a variety of materials such as glass, metal or plastic. The container can hold amino acid sequence(s), small molecule(s), nucleic acid sequence(s), cell population(s) and/or antibody(s). In one embodiment, the container holds a polynucleotide for use in examining the mRNA expression profile of a cell, together with reagents used for this purpose. In another embodiment a container comprises an antibody, binding fragment thereof or specific binding protein for use in evaluating protein expression of 109P1D4 in cells and tissues, or for relevant laboratory, prognostic, diagnostic, prophylactic and therapeutic purposes; indications and/or directions for such uses can be included on or with such container, as can reagents and other compositions or tools used for these purposes. In another embodiment, a container comprises materials for eliciting a cellular or humoral immune response, together with associated indications and/or directions. In another embodiment, a container comprises materials for adoptive immunotherapy, such as cytotoxic T cells (CTL) or helper T cells (HTL), together with associated indications and/or directions; reagents and other compositions or tools used for such purpose can also be included.

The container can alternatively hold a composition that is effective for treating, diagnosis, prognosing or prophylaxing a condition and can have a sterile access port (for example the container can be an intravenous solution bag or a vial having a stopper pierceable by a hypodermic injection needle). The active agents in the composition can be an antibody capable of specifically binding 109P1D4 and modulating the function of 109P1D4.

The article of manufacture can further comprise a second container comprising a pharmaceutically-acceptable buffer, such as phosphate-buffered saline, Ringer's solution and/or dextrose solution. It can further include other materials desirable from a commercial and user standpoint, including other buffers, diluents, filters, stirrers, needles, syringes, and/or package inserts with indications and/or instructions for use.

EXAMPLES

Various aspects of the invention are further described and illustrated by way of the several examples that follow, none of which is intended to limit the scope of the invention.

Example 1

SSH-Generated Isolation of cDNA Fragment of the 109P1D4 Gene

To isolate genes that are over-expressed in prostate cancer we used the Suppression Subtractive Hybridization (SSH) procedure using cDNA derived from prostate cancer tissues. The 109P1D4 SSH cDNA sequence was from an experiment where cDNA derived from LNCaP cells that was androgen-deprived (by growing in the presence of charcoal-stripped serum) was subtracted from cDNA derived from LNCaP cells that were stimulated with mibolerone for 9 hours.

Materials and Methods
Human Tissues:
The patient cancer and normal tissues were purchased from different sources such as the NDRI (Philadelphia, Pa.). mRNA for some normal tissues were purchased from different companies such as Clontech, Palo Alto, Calif.
RNA Isolation:
Tissues were homogenized in Trizol reagent (Life Technologies, Gibco BRL) using 10 ml/g tissue to isolate total RNA. Poly A RNA was purified from total RNA using Qiagen's Oligotex mRNA Mini and Midi kits. Total and mRNA were quantified by spectrophotometric analysis (O.D. 260/280 nm) and analyzed by gel electrophoresis.
Oligonucleotides:
The following HPLC purified oligonucleotides were used.

```
DPNCDN (cDNA synthesis primer):       (SEQ ID NO: 44)
5'TTTTGATCAAGCTT₃₀3'

Adaptor 1:                            (SEQ ID NO: 45)
5'CTAATACGACTCACTATAGGGCTCGAGCGGCCGCCCGGGCAG3'

(SEQ ID NO: 46)
3'GGCCCGTCCTAG5'

Adaptor 2:                            (SEQ ID NO: 47)
5'GTAATACGACTCACTATAGGGCAGCGTGGTCGCGGCCGAG3'
```

-continued

3'CGGCTCCTAG5' (SEQ ID NO: 48)

PCR primer 1: (SEQ ID NO: 49)
5'CTAATACGACTCACTATAGGGC3'

Nested primer (NP)1: (SEQ ID NO: 50)
5'TCGAGCGGCCGCCCGGGCAGGA3'

Nested primer (NP)2: (SEQ ID NO: 51)
5'AGCGTGGTCGCGGCCGAGGA3'

Suppression Subtractive Hybridization:

Suppression Subtractive Hybridization (SSH) was used to identify cDNAs corresponding to genes that may be differentially expressed in prostate cancer. The SSH reaction utilized cDNA from LNCaP prostate cancer cells.

The 109P1D4 SSH sequence was derived from cDNA subtraction of LNCaP stimulated with mibolerone minus LNCaP in the absence of androgen. The SSH DNA sequence (FIG. 1) was identified.

The cDNA derived from androgen-deprived LNCaP cells was used as the source of the "driver" cDNA, while the cDNA from androgen-stimulated LNCaP cells was used as the source of the "tester" cDNA. Double stranded cDNAs corresponding to tester and driver cDNAs were synthesized from 2 µg of poly(A)+ RNA isolated from the relevant xenograft tissue, as described above, using CLONTECH's PCR-Select cDNA Subtraction Kit and 1 µg of oligonucleotide DPNCDN as primer. First- and second-strand synthesis were carried out as described in the Kit's user manual protocol (CLONTECH Protocol No. PT1117-1, Catalog No. K1804-1). The resulting cDNA was digested with Dpn II for 3 hrs at 37° C. Digested cDNA was extracted with phenol/chloroform (1:1) and ethanol precipitated.

Tester cDNA was generated by diluting 1 µl of Dpn II digested cDNA from the relevant tissue source (see above) (400 ng) in 5 µl of water. The diluted cDNA (2 µl, 160 ng) was then ligated to 2 µl of Adaptor 1 and Adaptor 2 (10 µM), in separate ligation reactions, in a total volume of 10 µl at 16° C. overnight, using 400 µl of T4 DNA ligase (CLONTECH). Ligation was terminated with 1 µl of 0.2 M EDTA and heating at 72° C. for 5 min.

The first hybridization was performed by adding 1.5 µl (600 ng) of driver cDNA to each of two tubes containing 1.5 µl (20 ng) Adaptor 1- and Adaptor 2-ligated tester cDNA. In a final volume of 4 µl, the samples were overlaid with mineral oil, denatured in an MJ Research thermal cycler at 98° C. for 1.5 minutes, and then were allowed to hybridize for 8 hrs at 68° C. The two hybridizations were then mixed together with an additional 1 µl of fresh denatured driver cDNA and were allowed to hybridize overnight at 68° C. The second hybridization was then diluted in 200 µl of 20 mM Hepes, pH 8.3, 50 mM NaCl, 0.2 mM EDTA, heated at 70° C. for 7 min. and stored at −20° C.

PCR Amplification, Cloning and Sequencing of Gene Fragments Generated from SSH:

To amplify gene fragments resulting from SSH reactions, two PCR amplifications were performed. In the primary PCR reaction 1 µl of the diluted final hybridization mix was added to 1 µl of PCR primer 1 (10 µM), 0.5 µl dNTP mix (10 µM), 2.5 µl 10× reaction buffer (CLONTECH) and 0.5 µl 50× Advantage cDNA polymerase Mix (CLONTECH) in a final volume of 25 µl. PCR 1 was conducted using the following conditions: 75° C. for 5 min., 94° C. for 25 sec., then 27 cycles of 94° C. for 10 sec, 66° C. for 30 sec, 72° C. for 1.5 min. Five separate primary PCR reactions were performed for each experiment. The products were pooled and diluted 1:10 with water. For the secondary PCR reaction, 1 µl from the pooled and diluted primary PCR reaction was added to the same reaction mix as used for PCR 1, except that primers NP1 and NP2 (10 µM) were used instead of PCR primer 1. PCR 2 was performed using 10-12 cycles of 94° C. for 10 sec, 68° C. for 30 sec, and 72° C. for 1.5 minutes. The PCR products were analyzed using 2% agarose gel electrophoresis.

The PCR products were inserted into pCR2.1 using the T/A vector cloning kit (Invitrogen). Transformed E. coli were subjected to blue/white and ampicillin selection. White colonies were picked and arrayed into 96 well plates and were grown in liquid culture overnight. To identify inserts, PCR amplification was performed on 1 µl of bacterial culture using the conditions of PCR1 and NP1 and NP2 as primers. PCR products were analyzed using 2% agarose gel electrophoresis.

Bacterial clones were stored in 20% glycerol in a 96 well format. Plasmid DNA was prepared, sequenced, and subjected to nucleic acid homology searches of the GenBank, dBest, and NCI-CGAP databases.

RT-PCR Expression Analysis:

First strand cDNAs can be generated from 1 µg of mRNA with oligo (dT)12-18 priming using the Gibco-BRL Superscript Preamplification system. The manufacturer's protocol was used which included an incubation for 50 min at 42° C. with reverse transcriptase followed by RNAse H treatment at 37° C. for 20 min. After completing the reaction, the volume can be increased to 200 µl with water prior to normalization. First strand cDNAs from 16 different normal human tissues can be obtained from Clontech.

Normalization of the first strand cDNAs from multiple tissues was performed by using the primers 5'ATATCGCCGCGCTCGTCGTCGACAA3' (SEQ ID NO: 52)
and
5'AGCCACACGCAGCTCATTGTAGAAGG 3' (SEQ ID NO: 53)

to amplify β-actin. First strand cDNAs (5 µl) were amplified in a total volume of 50 µl containing 0.4 µM primers, 0.2 µM each dNTPs, 1× PCR buffer (Clontech, 10 mM Tris-HCL, 1.5 mM $MgCl_2$, 50 mM KCl, pH8.3) and 1× Klentaq DNA polymerase (Clontech). Five µl of the PCR reaction can be removed at 18, 20, and 22 cycles and used for agarose gel electrophoresis. PCR was performed using an MJ Research thermal cycler under the following conditions: Initial denaturation can be at 94° C. for 15 sec, followed by a 18, 20, and 22 cycles of 94° C. for 15 sec, 65° C. for 2 min, 72° C. for 5 sec. A final extension at 72° C. was carried out for 2 min. After agarose gel electrophoresis, the band intensities of the 283 base pair β-actin bands from multiple tissues were compared by visual inspection. Dilution factors for the first strand cDNAs were calculated to result in equal β-actin band intensities in all tissues after 22 cycles of PCR. Three rounds of normalization can be required to achieve equal band intensities in all tissues after 22 cycles of PCR.

To determine expression levels of the 109P1D4 gene, 5 µl of normalized first strand cDNA were analyzed by PCR using 26, and 30 cycles of amplification. Semi-quantitative expression analysis can be achieved by comparing the PCR products at cycle numbers that give light band intensifies. The primers used for RT-PCR were designed using the 109P1D4 SSH sequence and are listed below:

```
109P1D4.1
5'-TGGTCTTTCAGGTAATTGCTGTTG-3'    (SEQ ID NO: 54)

109P1D4.2
5'-CTCCATCAATGTTATGTTGCCTGT-3'   (SEQ ID NO: 55)
```

A typical RT-PCR expression analysis is shown in FIG. 15.

Example 2

Isolation of Full Length 109P1D4 Encoding DNA

The 109P1D4 SSH sequence of 192 bp (FIG. 1) exhibited homology to protocadherin 11 (PCDH11), a cell adhesion molecule related to the calcium dependent cadherins. The human cDNA sequence encodes a 1021 amino acid protein with an N-terminal leader sequence and a transmembrane domain. 109P1D4 v.1 of 4603bp was cloned from human prostate cancer xenograft LAPC-9AD cDNA library, revealing an ORF of 1021 amino acids (FIG. 2 and FIG. 3). Other variants (Transcript and SNP) of 109P1D4 were also identified and these are listed sequentially in FIG. 2 and FIG. 3.

Example 3

Chromosomal Mapping of 109P1D4

Chromosomal localization can implicate genes in disease pathogenesis. Several chromosome mapping approaches are available including fluorescent in situ hybridization (FISH), human/hamster radiation hybrid (RH) panels (Walter et al., 1994; Nature Genetics 7:22; Research Genetics, Huntsville Ala.), human-rodent somatic cell hybrid panels such as is available from the Coriell Institute (Camden, N.J.), and genomic viewers utilizing BLAST homologies to sequenced and mapped genomic clones (NCBI, Bethesda, Md.).

109P1D4 maps to chromosome Xq21.3 using 109P1D4 sequence and the NCBI BLAST tool: located on the World Wide Web at: (.ncbi.nlm.nih.gov/genome/seq/page.cgi?F=HsBlast.html&&ORG=Hs). 109P1D4 was also identified on chromosome Yp11.2, a region of 99% identity to Xq21.

Example 4

Expression Analysis of 109P1D4 in Normal Tissues and Patient Specimens

Expression analysis by RT-PCR and Northern analysis demonstrated that normal tissue expression of a gene of FIG. 2 is restricted predominantly to the tissues set forth in Table I.

Therapeutic applications for a gene of FIG. 2 include use as a small molecule therapy and/or a vaccine (T cell or antibody) target. Diagnostic applications for a gene of FIG. 2 include use as a diagnostic marker for local and/or metastasized disease. The restricted expression of a gene of FIG. 2 in normal tissues makes it useful as a tumor target for diagnosis and therapy. Expression analysis of a gene of FIG. 2 provides information useful for predicting susceptibility to advanced stage disease, rate of progression, and/or tumor aggressiveness. Expression status of a gene of FIG. 2 in patient samples, Tissue arrays and/or cell lines may be analyzed by: (i) immunohistochemical analysis; (ii) in situ hybridization; (iii) RT-PCR analysis on laser capture micro-dissected samples; (iv) Western blot analysis; and (v) Northern analysis.

RT-PCR analysis and Northern blotting were used to evaluate gene expression in a selection of normal and cancerous urological tissues. The results are summarized in FIGS. 15-19.

FIG. 14 shows expression of 109P1D4 in lymphoma cancer patient specimens. RNA was extracted from peripheral blood lymphocytes, cord blood isolated from normal individuals, and from lymphoma patient cancer specimens. Northern blots with 10 µg of total RNA were probed with the 109P1D4 sequence. Size standards in kilobases are on the side. Results show expression of 109P1D4 in lymphoma patient specimens but not in the normal blood cells tested.

FIG. 15 shows expression of 109P1D4 by RT-PCR. First strand cDNA was prepared from vital pool 1 (liver, lung and kidney), vital pool 2 (pancreas, colon and stomach), prostate cancer pool, bladder cancer pool, kidney cancer pool, colon cancer pool, lung cancer pool, ovary cancer pool, breast cancer pool, cancer metastasis pool, and pancreas cancer pool. Normalization was performed by PCR using primers to actin and GAPDH. Semi-quantitative PCR, using primers to 109P1D4, was performed at 30 cycles of amplification. Results show strong expression of 109P1D4 in all cancer pools tested. Very low expression was detected in the vital pools.

FIG. 16 shows expression of 109P1D4 in normal tissues. Two multiple tissue northern blots (Clontech), both with 2 µg of mRNA/lane, were probed with the 109P1D4 SSH fragment. Size standards in kilobases (kb) are indicated on the side. Results show expression of approximately 10 kb 109P1D4 transcript in ovary. Weak expression was also detected in placenta and brain, but not in the other normal tissues tested.

FIG. 17 shows expression of 109P1D4 in human cancer cell lines. RNA was extracted from a number of human prostate and bone cancer cell lines. Northern blots with 10 µg of total RNA/lane were probed with the 109P1D4 SSH fragment. Size standards in kilobases (kb) are indicated on the side. Results show expression of 109P1D4 in LAPC-9AD, LAPC-9Al, LNCaP prostate cancer cell lines, and in the bone cancer cell lines, SK-ES-1 and RD-ES.

Extensive expression of 109P1D4 in normal tissues is shown in FIG. 18A. A cDNA dot blot containing 76 different samples from human tissues was analyzed using a 109P1D4 SSH probe. Expression was only detected in multiple areas of the brain, placenta, ovary, and fetal brain, amongst all tissues tested.

FIG. 18B shows expression of 109P1D4 in patient cancer specimens. Expression of 109P1D4 was assayed in a panel of human cancers (T) and their respective matched normal tissues (N) on RNA dot blots. Upregulated expression of 109P1D4 in tumors compared to normal tissues was observed in uterus, lung and stomach. The expression detected in normal adjacent tissues (isolated from diseased tissues) but not in normal tissues (isolated from healthy donors) may indicate that these tissues are not fully normal and that 109P1D4 may be expressed in early stage tumors.

FIG. 19 shows 109P1D4 expression in lung cancer patient specimens. RNA was extracted from normal lung, prostate cancer xenograft LAPC-9AD, bone cancer cell line RD-ES, and lung cancer patient tumors. Northern blots with 10 µg of total RNA were probed with 109P1D4. Size standards in kilobases are on the side. Results show strong expression of 109P1D4 in lung tumor tissues as well as the RD-ES cell line, but not in normal lung.

The restricted expression of 109P1D4 in normal tissues and the expression detected in cancer patient specimens suggest that 109P1D4 is a potential therapeutic target and a diagnostic marker for human cancers.

Example 5

Splice Variants of 109P1D4

Transcript variants are variants of mature mRNA from the same gene which arise by alternative transcription or alternative splicing. Alternative transcripts are transcripts from the same gene but start transcription at different points. Splice variants are mRNA variants spliced differently from the same transcript. In eukaryotes, when a multi-exon gene is transcribed from genomic DNA, the initial RNA is spliced to produce functional mRNA, which has only exons and is used for translation into an amino acid sequence. Accordingly, a given gene can have zero to many alternative transcripts and each transcript can have zero to many splice variants. Each transcript variant has a unique exon makeup, and can have different coding and/or non-coding (5' or 3' end) portions, from the original transcript. Transcript variants can code for similar or different proteins with the same or a similar function or can encode proteins with different functions, and can be expressed in the same tissue at the same time, or in different tissues at the same time, or in the same tissue at different times, or in different tissues at different times. Proteins encoded by transcript variants can have similar or different cellular or extracellular localizations, e.g., secreted versus intracellular.

Transcript variants are identified by a variety of art-accepted methods. For example, alternative transcripts and splice variants are identified by full-length cloning experiment, or by use of full-length transcript and EST sequences. First, all human ESTs were grouped into clusters which show direct or indirect identity with each other. Second, ESTs in the same cluster were further grouped into sub-clusters and assembled into a consensus sequence. The original gene sequence is compared to the consensus sequence(s) or other full-length sequences. Each consensus sequence is a potential splice variant for that gene. Even when a variant is identified that is not a full-length clone, that portion of the variant is very useful for antigen generation and for further cloning of the full-length splice variant, using techniques known in the art.

Moreover, computer programs are available in the art that identify transcript variants based on genomic sequences. Genomic-based transcript variant identification programs include FgenesH (A. Salamov and V. Solovyev, "Ab initio gene finding in *Drosophila* genomic DNA," Genome Research. 2000 April;10(4):516-22); Grail (URL compbio.oml.gov/Grail-bin/EmptyGrailForm) and GenScan (URL genes.mit.edu/GENSCAN.html). For a general discussion of splice variant identification protocols see., e.g., Southan, C., A genomic perspective on human proteases, FEBS Lett. 2001 Jun. 8; 498(2-3):214-8; de Souza, S. J., et al, Identification of human chromosome 22 transcribed sequences with ORF expressed sequence tags, Proc. Natl Acad Sci U S A. 2000 Nov. 7; 97(23):12690-3.

To further confirm the parameters of a transcript variant, a variety of techniques are available in the art, such as fulllength cloning, proteomic validation, PCR-based validation, and 5' RACE validation, etc. (see e.g., Proteomic Validation: Brennan, S. O., et al., Albumin banks peninsula: a new termination variant characterized by electrospray mass spectrometry, Biochem Biophys Acta. 1999 Aug. 17; 1433(1-2): 321-6; Ferranti P, et al., Differential splicing of pre-messenger RNA produces multiple forms of mature caprine alpha(s1)-casein, Eur J Biochem. 1997 Oct. 1; 249(1):1-7. For PCR-based Validation: Wellmann S, et al., Specific reverse transcription-PCR quantification of vascular endothelial growth factor (VEGF) splice variants by LightCycler technology, Clin Chem. 2001 April; 47(4):654-60; Jia, H. P., et al., Discovery of new human beta-defensins using a genomics-based approach, Gene. 2001 Jan. 24; 263(1-2): 211-8. For PCR-based and 5' RACE Validation: Brigle, K. E., et al., Organization of the murine reduced folate carrier gene and identification of variant splice forms, Biochem Biophys Acta. 1997 Aug. 7; 1353(2): 191-8).

It is known in the art that genomic regions are modulated in cancers. When the genomic region to which a gene maps is modulated in a particular cancer, the alternative transcripts or splice variants of the gene are modulated as well. Disclosed herein is that 109P1D4 has a particular expression profile related to cancer. Alternative transcripts and splice variants of 109P1D4 may also be involved in cancers in the same or different tissues, thus serving as tumor-associated markers/antigens.

Using the full-length gene and EST sequences, 8 transcript variants were identified, designated as 109P1D4 v.2, v.3, v.4, v.5, v.6, v.7, v.8 and v.9. The boundaries of the exon in the original transcript, 109P1D4 v.1, were shown in Table LI. Compared with 109P1D4 v.1, transcript variant 109P1D4 v.3 has spliced out 2069-2395 from variant 109P1D4 v.1, as shown in FIG. 12. Variant 109P1D4 v.4 spliced out 1162-2096 of variant 109P1D4 v.1. Variant 109P1D4 v.5 added one exon to the 5' and extended 2 bp to the 5' end and 288 bp to the 3' end of variant 109P1D4 v.1. Theoretically, each different combination of exons in spatial order, e.g. exon 1 of v.5 and exons 1 and 2 of v.3 or v.4, is a potential splice variant.

Tables LII through LV are set forth on a variant-by-variant basis. Tables LII(a)-(h) show nucleotide sequence of the transcript variants. Tables LIII(a)-(h) show the alignment of the transcript variants with nucleic acid sequence of 109P1D4 v.1. Tables LIV(a)-(h) lay out amino acid translation of the transcript variants for the identified reading frame orientation. Tables LV(a)-(h) displays alignments of the amino acid sequence encoded by the splice variants with that of 109P1D4 v.1.

Example 6

Single Nucleotide Polymorphisms of 109P1D4

A Single Nucleotide Polymorphism (SNP) is a single base pair variation in a nucleotide sequence at a specific location. At any given point of the genome, there are four possible nucleotide base pairs: A/T, C/G, G/C and T/A. Genotype refers to the specific base pair sequence of one or more locations in the genome of an individual. Haplotype refers to the base pair sequence of more than one location on the same DNA molecule (or the same chromosome in higher organisms often in the context of one gene or in the context of several tightly linked genes. SNP that occurs on a cDNA is called cSNP. This cSNP may change amino acids of the protein encoded by the gene and thus change the functions of the protein. Some SNP cause inherited diseases; others contribute to quantitative variations in phenotype and reactions to environmental factors including diet and drugs among individuals. Therefore, SNP and/or combinations of alleles (called haplotypes) have many applications, including diagnosis of inherited diseases, determination of drug reactions and dosage, identification of genes responsible for diseases, and analysis of the genetic relationship between individuals (P. Nowotny, J. M. Kwon and A. M. Goate, "SNP analysis to dissect human traits," Curr. Opin. Neurobiol. 2001 October;

11(5):637-641; M. Pirmohamed and B. K. Park, "Genetic susceptibility to adverse drug reactions," Trends Pharmacol. Sci. 2001 June; 22(6):298-305; J. H. Riley, C. J. Allan, E. Lai and A. Roses, "The use of single nucleotide polymorphisms in the isolation of common disease genes," Pharmacogenomics. 2000 February; 1(1):39-47; R. Judson, J. C. Stephens and A. Windemuth, "The predictive power of haplotypes in clinical response," Pharmacogenomics. 2000 February; 1(1):15-26).

SNP are identified by a variety of art-accepted methods (P. Bean, "The promising voyage of SNP target discovery," Am. Clin. Lab. 2001 October-November; 20(9):18-20; K. M. Weiss, "In search of human variation," Genome Res. 1998 July; 8(7):691-697; M. M. She, "Enabling large-scale pharmacogenetic studies by high-throughput mutation detection and genotyping technologies," Clin. Chem. 2001 February; 47(2):164-172). For example, SNP can be identified by sequencing DNA fragments that show polymorphism by gel-based methods such as restriction fragment length polymorphism (RFLP) and denaturing gradient gel electrophoresis (DGGE). They can also be discovered by direct sequencing of DNA samples pooled from different individuals or by comparing sequences from different DNA samples. With the rapid accumulation of sequence data in public and private databases, one can discover SNP by comparing sequences using computer programs (Z. Gu, L. Hillier and P. Y. Kwok, "Single nucleotide polymorphism hunting in cyberspace," Hum. Mutat. 1998; 12(4):221-225). SNP can be verified and genotype or haplotype of an individual can be determined by a variety of methods including direct sequencing and high throughput microarrays (P. Y. Kwok, "Methods for genotyping single nucleotide polymorphisms," Annu. Rev. Genomics Hum. Genet. 2001; 2:235-258; M. Kokoris, K. Dix, K. Moynihan, J. Mathis, B. Erwin, P. Grass, B. Hines and A. Duesterhoeft, "High-throughput SNP genotyping with the Masscode system," Mol. Diagn. 2000 December; 5(4):329-340).

Using the methods described above, SNP were identified in the original transcript, 109P4D4 v.1, and its variants (see FIG. 2J and FIG. 2K). These alleles of the SNP, though shown separately here, can occur in different combinations (haplotypes) and in any one of the transcript variants (such as 109P4D4 v.4 or v.5) that contains the site of the SNP. Transcript variants v.4 and v.5 contained those SNP in the exons shared with variant v.3, and transcript variant v.9 contained all the SNP occurred in variant v.6 (see FIG. 10).

Example 7

Production of Recombinant 109P1D4 in Procaryotic Systems

To express recombinant 109P1D4 and 109P1D4 variants in prokaryotic cells, the full or partial length 109P1D4 and 109P1D4 variant cDNA sequences are cloned into any one of a variety of expression vectors known in the art. One or more of the following regions of 109P1D4 variants are expressed: the full length sequence presented in FIGS. 2 and 3, or any 8, 9, 10, 11, 12, 13, 14, 15, 16, 17, 18, 19, 20, 21, 22, 23, 24, 25, 26, 27, 28, 29, 30 or more contiguous amino acids from 109P1D4, variants, or analogs thereof.

A. In Vitro Transcription and Translation Constructs:

pCRII: To generate 109P1D4 sense and anti-sense RNA probes for RNA in situ investigations, pCRII constructs (Invitrogen, Carlsbad Calif.) are generated encoding either all or fragments of the 109P1D4 cDNA. The pCRII vector has Sp6 and T7 promoters flanking the insert to drive the transcription of 109P1D4 RNA for use as probes in RNA in situ hybridization experiments. These probes are used to analyze the cell and tissue expression of 109P1D4 at the RNA level. Transcribed 109P1D4 RNA representing the cDNA amino acid coding region of the 109P1D4 gene is used in in vitro translation systems such as the TnT™ Coupled Reticulolysate System (Promega, Corp., Madison, Wis.) to synthesize 109P1D4 protein.

B. Bacterial Constructs:

pGEX Constructs: To generate recombinant 109P1D4 proteins in bacteria that are fused to the Glutathione S-transferase (GST) protein, all or parts of the 109P1D4 cDNA protein coding sequence are cloned into the pGEX family of GST-fusion vectors (Amersham Pharmacia Biotech, Piscataway, N.J.). These constructs allow controlled expression of recombinant 109P1D4 protein sequences with GST fused at the amino-terminus and a six histidine epitope (6× His) at the carboxyl-terminus. The GST and 6× His tags permit purification of the recombinant fusion protein from induced bacteria with the appropriate affinity matrix and allow recognition of the fusion protein with anti-GST and anti-His antibodies. The 6× His tag is generated by adding 6 histidine codons to the cloning primer at the 3' end, e.g., of the open reading frame (ORF). A proteolytic cleavage site, such as the PreScission™ recognition site in pGEX-6P-1, may be employed such that it permits cleavage of the GST tag from 109P1D4-related protein. The ampicillin resistance gene and pBR322 origin permits selection and maintenance of the pGEX plasmids in E. coli.

pMAL Constructs: To generate, in bacteria, recombinant 109P1D4 proteins that are fused to maltose-binding protein (MBP), all or parts of the 109P1D4 cDNA protein coding sequence are fused to the MBP gene by cloning into the pMAL-c2X and pMAL-p2X vectors (New England Biolabs, Beverly, Mass.). These constructs allow controlled expression of recombinant 109P1D4 protein sequences with MBP fused at the amino-terminus and a 6× His epitope tag at the carboxyl-terminus. The MBP and 6× His tags permit purification of the recombinant protein from induced bacteria with the appropriate affinity matrix and allow recognition of the fusion protein with anti-MBP and anti-His antibodies. The 6× His epitope tag is generated by adding 6 histidine codons to the 3' cloning primer. A Factor Xa recognition site permits cleavage of the pMAL tag from 109P1D4. The pMAL-c2X and pMAL-p2X vectors are optimized to express the recombinant protein in the cytoplasm or periplasm respectively. Periplasm expression enhances folding of proteins with disulfide bonds. In one embodiment, amino acids 24419 of 109P1D4 variant 1 was cloned into the pMAL-c2X vector and was used to express the fusion protein.

pET Constructs: To express 109P1D4 in bacterial cells, all or parts of the 109P1D4 cDNA protein coding sequence are cloned into the pET family of vectors (Novagen, Madison, Wis.). These vectors allow tightly controlled expression of recombinant 109P1D4 protein in bacteria with and without fusion to proteins that enhance solubility, such as NusA and thioredoxin (Trx), and epitope tags, such as 6× His and S-Tag™ that aid purification and detection of the recombinant protein. For example, constructs are made utilizing pET NusA fusion system 43.1 such that regions of the 109P1D4 protein are expressed as amino-terminal fusions to NusA. In 2 embodiments, amino acids 24-419 and 24-815 were cloned into pET43.1 vector and used to express the fusion protein.

C. Yeast Constructs:

pESC Constructs: To express 109P1D4 in the yeast species Saccharomyces cerevisiae for generation of recombinant protein and functional studies, all or parts of the 109P1D4 cDNA protein coding sequence are cloned into the pESC family of vectors each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is useful to confirm protein-protein interactions of 109P1D4. In addition, expression in yeast yields similar post-translational modifications, such as glycosylations and phosphorylations, that are found when expressed in eukaryotic cells.

pESP Constructs: To express 109P1D4 in the yeast species *Saccharomyces pombe*, all or parts of the 109P1D4 cDNA protein coding sequence are cloned into the pESP family of vectors. These vectors allow controlled high level of expression of a 109P1D4 protein sequence that is fused at either the amino terminus or at the carboxyl terminus to GST which aids purification of the recombinant protein. A Flag™epitope tag allows detection of the recombinant protein with anti-Flag™ antibody.

Example 8

Production of Recombinant 109P1D4 in Higher Eukaryotic Systems

A. Mammalian Constructs:

To express recombinant 109P1D4 in eukaryotic cells, the full or partial length 109P1D4 cDNA sequences were cloned into any one of a variety of expression vectors known in the art. One or more of the following regions of 109P1D4 were expressed in these constructs, amino acids 1 to 1021 or any 8, 9, 10, 11, 12, 13, 14, 15, 16, 17, 18, 19, 20, 21, 22, 23, 24, 25, 26, 27, 28, 29, 30 or more contiguous amino acids from 109P1D4 v.1; amino acids 1 to 1054, 1 to 1347, 1 to 1337, 1 to 1310, 1 to 1037, 1 to 1048, 1 to 1340 of v.2, v.3, v.4, v.5, v.6, v.7, and v.8 respectively; or any 8, 9, 10, 11, 12, 13, 14, 15, 16, 17, 18, 19, 20, 21, 22, 23, 24, 25, 26, 27, 28, 29, 30 or more contiguous amino acids from 109P1D4 variants, or analogs thereof.

The constructs can be transfected into any one of a wide variety of mammalian cells such as 293T cells. Transfected 293T cell lysates can be probed with the anUt-109P1D4 polyclonal serum, described herein.

PcDNA4/HisMax Constructs: To express 109P1D4 in mammalian cells, a 109P1D4 ORF, or portions thereof, of 109P1D4 are cloned into pcDNA4/HisMax Version A (Invitrogen, Carlsbad, Calif.). Protein expression is driven from the cytomegalovirus (CMV) promoter and the SP16 translational enhancer. The recombinant protein has Xpress™ and six histidine (6× His) epitopes fused to the amino-terminus. The pcDNA4/HisMax vector also contains the bovine growth hormone (BGH) polyadenylation signal and transcription termination sequence to enhance mRNA stability along with the SV40 origin for episomal replication and simple vector rescue in cell lines expressing the large T antigen. The Zeocin resistance gene allows for selection of mammalian cells expressing the protein and the ampicillin resistance gene and ColE1 origin permits selection and maintenance of the plasmid in *E. coli*.

PcDNA3.1 MycHis Constructs: To express 109P1D4 in mammalian cells, a 109P1D4 ORF, or portions thereof, of 109P1D4 with a consensus Kozak translation initiation site was cloned into pcDNA3.1/MycHis Version A (Invitrogen, Carlsbad, Calif.). Protein expression is driven from the cytomegalovirus (CMV) promoter. The recombinant proteins have the myc epitope and 6× His epitope fused to the carboxyl-terminus. The pcDNA3.1/MycHis vector also contains the bovine growth hormone (BGH) polyadenylation signal and transcription termination sequence to enhance mRNA stability, along with the SV40 origin for episomal replication and simple vector rescue in cell lines expressing the large T antigen. The Neomycin resistance gene can be used, as it allows for selection of mammalian cells expressing the protein and the ampicillin resistance gene and ColE1 origin permits selection and maintenance of the plasmid in *E. coli*.

The complete ORF of 109P1D4 v.1 was cloned into the pcDNA3.1/MycHis construct to generate 109P1D4.pcDNA3.1/MycHis.

pcDNA3.1/CT-GFP-TOPO Construct: To express 109P1D4 in mammalian cells and to allow detection of the recombinant proteins using fluorescence, a 109P1D4 ORF, or portions thereof, with a consensus Kozak translation initiation site are cloned into pcDNA3.1/CT-GFP-TOPO (Invitrogen, CA). Protein expression is driven from the cytomegalovirus (CMV) promoter. The recombinant proteins have the Green Fluorescent Protein (GFP) fused to the carboxyl-terminus facilitating non-invasive, in vivo detection and cell biology studies. The pcDNA3.1CT-GFP-TOPO vector also contains the bovine growth hormone (BGH) polyadenylation signal and transcription termination sequence to enhance mRNA stability along with the SV40 origin for episomal replication and simple vector rescue in cell lines expressing the large T antigen. The Neomycin resistance gene allows for selection of mammalian cells that express the protein, and the ampicillin resistance gene and ColE1 origin permits selection and maintenance of the plasmid in *E. coli*. Additional constructs with an amino-terminal GFP fusion are made in pcDNA3.1/NT-GFP-TOPO spanning the entire length of a 109P1D4 protein.

PAPtag: A 109P1D4 ORF, or portions thereof, is cloned into pAPtag-5 (GenHunter Corp. Nashville, Tenn.). This construct generates an alkaline phosphatase fusion at the carboxyl-terminus of a 109P1D4 protein while fusing the IgGκ signal sequence to the amino-terminus. Constructs are also generated in which alkaline phosphatase with an amino-terminal IgGκ signal sequence is fused to the amino-terminus of a 109P1D4 protein. The resulting recombinant 109P1D4 proteins are optimized for secretion into the media of transfected mammalian cells and can be used to identify proteins such as ligands or receptors that interact with 109P1D4 proteins. Protein expression is driven from the CMV promoter and the recombinant proteins also contain myc and 6× His epitopes fused at the carboxyl-terminus that facilitates detection and purification. The Zeocin resistance gene present in the vector allows for selection of mammalian cells expressing the recombinant protein and the ampicillin resistance gene permits selection of the plasmid in *E. coli*.

pTag5: A 109P1D4 ORF, or portions thereof, were cloned into pTag-5. This vector is similar to pAPtag but without the alkaline phosphatase fusion. This construct generated 109P1D4 protein with an amino-terminal IgGκ signal sequence and myc and 6× His epitope tags at the carboxyl-terminus that facilitate detection and affinity purification. The resulting recombinant 109P1D4 protein was optimized for secretion into the media of transfected mammalian cells, and was used as immunogen or ligand to identify proteins such as ligands or receptors that interact with the 109P1D4 proteins. Protein expression is driven from the CMV promoter. The Zeocin resistance gene present in the vector allows for selection of mammalian cells expressing the protein, and the ampicillin resistance gene permits selection of the plasmid in *E. coli*.

PsecFc: A 109P1D4 ORF, or portions thereof, is also cloned into psecFc. The psecFc vector was assembled by cloning the human immunoglobulin G1 (IgG) Fc (hinge, CH2, CH3 regions) into pSecTag2 (Invitrogen, California). This construct generates an IgG1 Fc fusion at the carboxyl-terminus of the 109P1D4 proteins, while fusing the IgGK signal sequence to N-terminus. 109P1D4 fusions utilizing the murine IgG1 Fc region are also used. The resulting recombinant 109P1D4 proteins are optimized for secretion into the media of transfected mammalian cells, and can be used as immunogens or to identify proteins such as ligands or receptors that interact with 109P1D4 protein. Protein expression is driven from the CMV promoter. The hygromycin resistance gene present in the vector allows for selection of mammalian cells that express the recombinant protein, and the ampicillin resistance gene permits selection of the plasmid in *E. coli*.

pSRα Constructs: To generate mammalian cell lines that express 109P1D4 constitutively, 109P1D4 ORF, or portions thereof, were cloned into pSRα constructs. Amphotropic and ecotropic retroviruses were generated by transfection of pSRα constructs into the 293T-10A1 packaging line or co-transfection of pSRα and a helper plasmid (containing deleted packaging sequences) into the 293 cells, respectively. The retrovirus is used to infect a variety of mammalian cell lines, resulting in the integration of the cloned gene, 109P1D4, into the host cell-lines. Protein expression is driven from a long terminal repeat (LTR). The Neomycin resistance gene present in the vector allows for selection of mammalian cells that express the protein, and the ampicillin resistance gene and ColE1 origin permit selection and maintenance of the plasmid in *E. coli*. The retroviral vectors can thereafter be used for infection and generation of various cell lines using, for example, PC3, NIH 3T3, TsuPr1, 293 or rat-1 cells.

Additional pSRα constructs are made that fuse an epitope tag such as the FLAG™ tag to the carboxyl-terminus of 109P1D4 sequences to allow detection using anti-Flag antibodies. For example, the FLAG™ sequence 5' GAT TAC AAG GAT GAC GAC GAT AAG 3' (SEQ ID NO: 56) is added to cloning primer at the 3' end of the ORF. Additional pSRα constructs are made to produce both amino-terminal and carboxyl-terminal GFP and myc/6× His fusion proteins of the full-length 109P1D4 proteins.

Additional Viral Vectors: Additional constructs are made for viral-mediated delivery and expression of 109P1D4. High virus titer leading to high level expression of 109P1D4 is achieved in viral delivery systems such as adenoviral vectors and herpes amplicon vectors. A 109P1D4 coding sequence or fragments thereof are amplified by PCR and subcloned into the AdEasy shuttle vector (Stratagene). Recombination and virus packaging are performed according to the manufacturer's instructions to generate adenoviral vectors. Alternatively, 109P1D4 coding sequences or fragments thereof are cloned into the HSV-1 vector (Imgenex) to generate herpes viral vectors. The viral vectors are thereafter used for infection of various cell lines such as PC3, NIH 3T3, 293 or rat-1 cells.

Regulated Expression Systems: To control expression of 109P1D4 in mammalian cells, coding sequences of 109P1D4, or portions thereof, are cloned into regulated mammalian expression systems such as the T-Rex System (Invitrogen), the GeneSwitch System (Invitrogen) and the tighly-regulated Ecdysone System (Stratagene). These systems allow the study of the temporal and concentration dependent effects of recombinant 109P1D4. These vectors are thereafter used to control expression of 109P1D4 in various cell lines such as PC3, NIH 3T3, 293 or rat-1 cells.

B. Baculovirus Expression Systems

To generate recombinant 109P1D4 proteins in a baculovirus expression system, 109P1D4 ORF, or portions thereof, are cloned into the baculovirus transfer vector pBlueBac 4.5 (Invitrogen), which provides a His-tag at the N-terminus. Specifically, pBlueBac-109P1D4 is co-transfected with helper plasmid pBac-N-Blue (Invitrogen) into SF9 (*Spodoptera frugiperda*) insect cells to generate recombinant baculovirus (see Invitrogen instruction manual for details). Baculovirus is then collected from cell supernatant and purified by plaque assay.

Recombinant 109P1D4 protein is then generated by infection of HighFive insect cells (Invitrogen) with purified baculovirus. Recombinant 109P1D4 protein can be detected using anti-109P1D4 or anti-His-tag antibody. 109P1D4 protein can be purified and used in various cell-based assays or as immunogen to generate polyclonal and monoclonal antibodies specific for 109P1D4.

Example 9

Antigenicity Profiles and Secondary Structure

FIG.(S) 5A-I, FIG. 6A-I, FIG. 7A-I, FIG. 8A-I, and FIG. 9A-I depict graphically five amino acid profiles of 109P1D4 variants 1 through 9, each assessment available by accessing the ProtScale website located on the World Wide Web at (.expasy.ch/cgi-bin/protscale.pl) on the ExPasy molecular biology server.

These profiles: FIG. 5, Hydrophilicity, (Hopp T. P., Woods K. R., 1981. Proc. Natl. Acad. Sci. U.S.A. 78:3824-3828); FIG. 6, Hydropathicity, (Kyte J., Doolittle R. F., 1982. J. Mol. Biol. 157:105-132); FIG. 7, Percentage Accessible Residues (Janin J., 1979 Nature 277:491-492); FIG. 8, Average Flexibility, (Bhaskaran R., and Ponnuswamy P. K., 1988. Int. J. Pept. Protein Res. 32:242-255); FIG. 9, Beta-turn (Deleage, G., Roux B. 1987 Protein Engineering 1:289-294); and optionally others available in the art, such as on the ProtScale website, were used to identify antigenic regions of each of the 109P1D4 variant proteins. Each of the above amino acid profiles of 109P1D4 variants were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profile, and values less than 0.5 on the Hydropathicity profile). Such regions are likely to be exposed to the aqueous environment, be present on the surface of the protein, and thus available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed on the protein and thus accessible to immune recognition, such as by antibodies.

Antigenic sequences of the 109P1D4 variant proteins indicated, e.g., by the profiles set forth in FIG. 5, FIG. 6, FIG. 7, FIG. 8, and/or FIG. 9 are used to prepare immunogens, either peptides or nucleic acids that encode them, to generate therapeutic and diagnostic anti-109P1D4 antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from the 109P1D4 protein variants listed in FIGS. 2 and 3. In particular, peptide immunogens of the invention can comprise, a peptide region of at least 5 amino adds of FIGS. 2 and 3 in any whole number increment that includes an amino acid position having a value greater than 0.5 in the Hydrophilicity profiles of FIG. 5; a peptide region of at least 5 amino acids of FIGS. 2 and 3 in any whole number increment that includes an amino acid position having a value less than 0.5 in the Hydropathicity profile of FIG. 6; a peptide region of at least 5 amino acids of FIGS. 2 and 3 in any whole number increment that includes an amino acid position having a value greater than 0.5 in the Percent Accessible Residues profiles of FIG. 7; a peptide region of at least 5 amino acids of FIGS. 2 and 3 in any whole number increment that includes an amino acid position having a value greater than 0.5 in the Average Flexibility profiles on FIG. 8; and, a peptide region of at least 5 amino acids of FIGS. 2 and 3 in any whole number increment that includes an amino acid position having a value greater than 0.5 in the Beta-turn profile of FIGS. 9. Peptide immunogens of the invention can also comprise nucleic acids that encode any of the forgoing.

All immunogens of the invention, peptide or nucleic acid, can be embodied in human unit dose form, or comprised by a composition that includes a pharmaceutical excipient compatible with human physiology.

The secondary structure of 109P1D4 protein variants, namely the predicted presence and location of alpha helices, extended strands, and random coils, are predicted from the primary amino acid sequence using the HNN—Hierarchical Neural Network method (NPS@: Network Protein Sequence Analysis TIBS 2000 March Vol. 25, No. 3 [291]:147-150 Combet C., Blanchet C., Geourjon C. and Deleage G., http: pbil.ibcp.fr/cgi-bin/npsa_automat.pl?page=npsa_nn.html), accessed from the ExPasy molecular biology server located on the World Wide Web at (www.expasy.ch/tools/). This analysis for protein variants 1 through 9 are shown in FIG. 13A through 13I respectively. The percent of structure for each variant comprised of alpha helix, extended strand, and random coil is also indicated.

Analysis for the potential presence of transmembrane domains in 109P1D4 variant proteins was carried out using a variety of transmembrane prediction algorithms accessed from the ExPasy molecular biology server located on the World Wide Web at (www.expasy.ch/tools/). Shown graphically in FIGS. 13J-R are the results of analyses using the TMpred program (top panels) and the TMHMM program (bottom panels) of 109P1D4 protein variants 1 through 9 respectively. Analyses of the variants using other structural prediction programs are summarized in Table VI and Table L.

Example 10

Generation of 109P1D4 Polyclonal Antibodies

Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. In addition to immunizing with a full length 109P1D4 protein variant, computer algorithms are employed in design of immunogens that, based on amino acid sequence analysis contain characteristics of being antigenic and available for recognition by the immune system of the immunized host (see the Example entitled "Antigenicity Profiles and Secondary Structure").

Such regions would be predicted to be hydrophilic, flexible, in beta-turn conformations, and be exposed on the surface of the protein (see, e.g., FIG. 5, FIG. 6, FIG. 7, FIG. 8, or FIG. 9 for amino acid profiles that indicate such regions of 109P1D4 protein variant 1).

For example, recombinant bacterial fusion proteins or peptides containing hydrophilic, flexible, beta-turn regions of 109P1D4 protein variants are used as antigens to generate polyclonal antibodies in New Zealand White rabbits or monoclonal antibodies as described in the example entitled "Generation of 109P1D4 Monoclonal Antibodies (mAbs)". For example, in 109P1D4 variant 1, such regions include, but are not limited to, amino acids 22-39, amino acids 67-108, amino acids 200-232, amino acids 454-499, amino acids 525-537, amino acids 640-660, amino acids 834-880, and amino acids 929-942. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In 2 embodiments, peptides encoding amino acids 77-90 and amino acids 929-942 of 109P1D4 variant 1 were synthesized, conjugated to KLH, and used to immunize separate rabbits. Alternatively the immunizing agent may include all or portions of the 109P1D4 variant proteins, analogs or fusion proteins thereof. For example, the 109P1D4 variant 1 amino acid sequence can be fused using recombinant DNA techniques to any one of a variety of fusion protein partners that are well known in the art, such as glutathione-S-transferase (GST) and HIS tagged fusion proteins. In 1 embodiment, amino acids 24-419 of 109P1D4 variant 1 was fused to NUSa using recombinant techniques and the pET43.1 expression vector, expressed, purified and used to immunize a rabbit. Such fusion proteins are purified from induced bacteria using the appropriate affinity matrix.

Other recombinant bacterial fusion proteins that may be employed include maltose binding protein, LacZ, thioredoxin, NusA, or an immunoglobulin constant region (see the section entitled "Production of 109P1D4 in Prokaryotic Systems" and Current Protocols In Molecular Biology, Volume 2, Unit 16, Frederick M. Ausubul et al. eds., 1995; Linsley, P. S., Brady, W., Umes, M., Grosmaire, L., Damle, N., and Ledbetter, J.(1991) J.Exp. Med. 174, 561-566).

In addition to bacterial derived fusion proteins, mammalian expressed protein antigens are also used. These antigens are expressed from mammalian expression vectors such as the Tag5 and Fc-fusion vectors (see the section entitled "Production of Recombinant 109P1D4 in Eukaryotic Systems"), and retain post-translational modifications such as glycosylations found in naive protein. In one embodiment, amino acids 24-812 of 109P1D4 variant 1 was cloned into the Tag5 mammalian secretion vector, and expressed in 293T cells (See FIG. 20). The recombinant protein is purified by metal chelate chromatography from tissue culture supernatants of 293T cells stably expressing the recombinant vector. The purified Tag5 109P1D4 protein is then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 μg, typically 100-200 μg, of fusion protein or peptide conjugated to KLH mixed in complete Freund's adjuvant (CFA). Rabbits are then injected subcutaneously every two weeks with up to 200 μg, typically 100-200

μg, of the immunogen in incomplete Freund's adjuvant (IFA). Test bleeds are taken approximately 7-10 days following each immunization and used to monitor the titer of the antiserum by ELISA.

To test reactivity and specificity of immune serum, such as the rabbit serum derived from immunization with the NUSa-fusion of 109P1D4 variant 1 protein, the full-length 109P1D4 variant 1 cDNA is cloned into pCDNA 3.1 myc-his expression vector (Invitrogen, see the Example entitled "Production of Recombinant 109P1D4 in Eukaryotic Systems"). After transfection of the constructs into 293T cells, cell lysates are probed with the anti-109P1D4 serum to determine specific reactivity to denatured 109P1D4 protein using the Western blot technique. Probing with anti-His antibody serves as a positive control for expression of 109P1D4 in the transfected cells (See FIG. 21). In addition, the immune serum is tested by fluorescence microscopy, flow cytometry and immunoprecipitation against 293T and other recombinant 109P1D4-expressing cells to determine specific recognition of native protein. Western blot, immunoprecipitation, fluorescent microscopy, and flow cytometric techniques using cells that endogenously express 109P1D4 are also carried out to test reactivity and specificity.

Anti-serum from rabbits immunized with 109P1D4 variant fusion proteins, such as GST and MBP fusion proteins, are purified by depletion of antibodies reactive to the fusion partner sequence by passage over an affinity column containing the fusion partner either alone or in the context of an irrelevant fusion protein. For example, antiserum derived from a NUSa-109P1D4 variant 1 fusion protein is first purified by passage over a column of MBP protein covalently coupled to AffiGel matrix (BioRad, Hercules, Calif.). The antiserum is then affinity purified by passage over a column composed of a NUSa-109P1D4 fusion protein covalently coupled to Affigel matrix. The serum is then further purified by protein G affinity chromatography to isolate the IgG fraction. Sera from other His-tagged antigens and peptide immunized rabbits as well as fusion partner depleted sera are affinity purified by passage over a column matrix composed of the original protein immunogen or free peptide.

Example 11

Generation of 109P1D4 Monoclonal Antibodies (mAbs)

In one embodiment, therapeutic mAbs to 109P1D4 variants comprise those that react with epitopes specific for each variant protein or specific to sequences in common between the variants that would disrupt or modulate the biological function of the 109P1D4 variants, for example those that would disrupt the interaction with ligands and binding partners. Immunogens for generation of such mAbs include those designed to encode or contain the entire 109P1D4 protein variant sequence, regions predicted to contain functional motifs, and regions of the 109P1D4 protein variants predicted to be antigenic from computer analysis of the amino acid sequence (see, e.g., FIG. 5, FIG. 6, FIG. 7, FIG. 8, or FIG. 9, and the Example entitled "Antigenicity Profiles and Secondary Structure"). Immunogens include peptides, recombinant bacterial proteins, and mammalian expressed Tag 5 proteins and human and murine IgG FC fusion proteins. In addition, cells engineered to express high levels of a respective 109P1D4 variant, such as 293T-109P1D4 variant 1 or 300.19-109P1D4 variant 1 murine Pre-B cells, are used to immunize mice.

To generate mAbs to a 109P1D4 variant, mice are first immunized intraperitoneally (IP) with, typically, 10-50 μg of protein immunogen or $10^7$ 109P1D4-expressing cells mixed in complete Freund's adjuvant. Mice are then subsequently immunized IP every 2-4 weeks with, typically, 10-50 μg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding a 109P1D4 variant sequence is used to immunize mice by direct injection of the plasmid DNA. For example, amino acids 24-812 of 109P1D4 of variant 1 is cloned into the Tag5 mammalian secretion vector and the recombinant vector will then be used as immunogen. In another example the same amino acids are cloned into an Fc-fusion secretion vector in which the 109P1D4 variant 1 sequence is fused at the amino-terminus to an IgK leader sequence and at the carboxyl-terminus to the coding sequence of the human or murine IgG Fc region. This recombinant vector is then used as immunogen. The plasmid immunization protocols are used in combination with purified proteins expressed from the same vector and with cells expressing the respective 109P1D4 variant.

Alternatively, mice may be immunized directly into their footpads. In this case, 10-50 μg of protein immunogen or $10^7$ 254P1D6B-expressing cells are injected sub-cutaneously into the footpad of each hind leg. The first immunization is given with Titermax (Sigma™) as an adjuvant and subsequent injections are given with Alum-gel in conjunction with CpG oligonucleotide sequences with the exception of the final injection which is given with PBS. Injections are given twice weekly (every three to four days) for a period of 4 weeks and mice are sacrificed 3-4 days after the final injection, at which point lymph nodes immediately draining from the footpad are harvested and the B-cells are collected for use as antibody producing fusion partners.

During the immunization protocol, test bleeds are taken 7-10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment for generating 109P1D4 monoclonal antibodies, a Tag5 antigen of variant 1 encoding amino acids 14-812 is expressed in 293T cells and purified from conditioned media. Balb C mice are initially immunized intraperitoneally with 25 μg of the Tag5 109P1D4 variant 1 protein mixed in complete Freund's adjuvant. Mice are subsequently immunized every two weeks with 25 μg of the antigen mixed in incomplete Freund's adjuvant for a total of three immunizations. ELISA using the Tag5 antigen determines the titer of serum from immunized mice. Reactivity and specificity of serum to full length 109P1D4 variant 1 protein is monitored by Western blotting, immunoprecipitation and flow cytometry using 293T cells transfected with an expression vector encoding the 109P1D4 variant 1 cDNA (see e.g., the Example entitled "Production of Recombinant 109P1D4 in Higher Eukaryotic Systems" and FIG. 21). Other recombinant 109P1D4 variant 1-expressing cells or cells endogenously expressing 109P1D4 variant 1 are also used. Mice showing the strongest reactivity are rested and given a final injection of antigen in PBS and then sacrificed four days later. The spleens of the sacrificed mice are harvested and fused to SPO/2 myeloma cells using standard procedures (Harlow and Lane, 1988). Supernatants from HAT selected growth wells are screened by ELISA, Western blot, immunoprecipitation, fluorescent microscopy, and flow cytometry to identify 109P1D4 specific antibody-producing clones.

To generate monoclonal antibodies that are specific for a 109P1D4 variant protein, immunogens are designed to encode sequences unique for each variant. In one embodiment, an antigenic peptide composed of amino acids 1-29 of 109P1D4 variant 2 is coupled to KLH to derive monoclonal antibodies specific to 109P1D4 variant 2. In another embodiment, an antigenic peptide comprised of amino acids 1-23 of 109P1D4 variant 6 is coupled to KLH and used as immunogen to derive variant 6 specific MAbs. In another example, a GST-fusion protein encoding amino acids 1001-1347 of variant 3 is used as immunogen to generate antibodies that would recognize variants 3, 4, 5, and 8, and distinguish them from variants 1, 2, 6, 7 and 9. Hybridoma supernatants are then screened on the respective antigen and then further screened on cells expressing the specific variant and cross-screened on cells expressing the other variants to derive variant-specific monoclonal antibodies.

The binding affinity of 109P1D4 variant specific monoclonal antibodies are determined using standard technologies. Affinity measurements quantify the strength of antibody to epitope binding and are used to help define which 109P1D4 variant monoclonal antibodies preferred for diagnostic or therapeutic use, as appreciated by one of skill in the art. The BIAcore system (Uppsala, Sweden) is a preferred method for determining binding affinity. The BIAcore system uses surface plasmon resonance (SPR, Welford K. 1991, Opt. Quant. Elect. 23:1; Morton and Myszka, 1998, Methods in Enzymology 295: 268) to monitor biomolecular interactions in real time. BIAcore analysis conveniently generates association rate constants, dissociation rate constants, equilibrium dissociation constants, and affinity constants. Alternatively, equilibrium binding analysis of MAbs on 109P1D4-expressing cells can be used to determine affinity.

Example 12

HLA Class I and Class II Binding Assays

HLA class I and class II binding assays using purified HLA molecules are performed in accordance with disclosed protocols (e.g., PCT publications WO 94/20127 and WO 94/03205; Sidney et al., *Current Protocols in Immunology* 18.3.1 (1998); Sidney, et al., *J. Immunol.* 154:247 (1995); Selte, et al., Mol. Immunol. 31:813 (1994)). Briefly, purified MHC molecules (5 to 500 nM) are incubated with various unlabeled peptide inhibitors and 1-10 nM $^{125}$I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10-20% of the total radioactivity. All subsequent inhibition and direct binding assays are performed using these HLA concentrations.

Since under these conditions [label]<[HLA] and $IC_{50} \geqq$ [HLA], the measured $IC_{50}$ values are reasonable approximations of the true $K_D$ values. Peptide inhibitors are typically tested at concentrations ranging from 120 μg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the ICso for each tested peptide (typically unlabeled versions of the radiolabeled probe peptide). For database purposes, and inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides (see Table IV).

Example 13

Identification of HLA Supermotif- and Motif-Bearing CTL Candidate Epitopes

HLA vaccine compositions of the invention can include multiple epitopes. The multiple epitopes can comprise multiple HLA supermotifs or motifs to achieve broad population coverage. This example illustrates the identification and confirmation of supermotif- and motif-bearing epitopes for the inclusion in such a vaccine composition. Calculation of population coverage is performed using the strategy described below.

Computer Searches and Algorithms for Identification of Supermotif and/or Motif-Bearing Epitopes The searches performed to identify the motif-bearing peptide sequences in the Example entitled "Antigenicity Profiles" and Tables VIII-XXI and XXII-XLIX employ the protein sequence data from the gene product of 109P1D4 set forth in FIGS. 2 and 3, the specific search peptides used to generate the tables are listed in Table VII.

Computer searches for epitopes bearing HLA Class I or Class II supermotifs or motifs are performed as follows. All translated 109P1D4 protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or ΔG) of peptide-HLA molecule interactions can be approximated as a linear polynomial function of the type:

$$``\Delta G" = a_{1i} \times a_{2i} \times a_{3i} \ldots \times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount $j_i$ to the free energy of binding of the peptide irrespective of the sequence of the rest of the peptide.

The method of derivation of specific algorithm coefficients has been described in Gulukota et at., *J. Mol. Biol.* 267:1258-126, 1997; (see also Sidney et al., *Human Immunol.* 45:79-93, 1996; and Southwood et al., *J. Immunol.* 160:3363-3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-Reactive Peptides

Protein sequences from 109P1D4 are scanned utilizing motif identification software, to identify 8-, 9- 10- and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-Bearing Epitopes

The 109P1D4 protein sequence(s) scanned above is also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of $\leq$500 nM, often $\leq$200 nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 Supermotif Bearing Epitopes

The 109P1D4 protein(s) scanned above is also analyzed for the presence of 8-, 9- 10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with $IC_{50}$ of $\leq$500 nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 Motif-Bearing Epitopes

To further increase population coverage, HLA-A1 and -A24 epitopes can also be incorporated into vaccine compositions. An analysis of the 109P1D4 protein can also be performed to identify HLA-A1- and A24-motif-containing sequences.

High affinity and/or cross-reactive binding epitopes that bear other motif and/or supermotifs are identified using analogous methodology.

Example 14

Confirmation of Immunogenicity

Cross-reactive candidate CTL A2-supermotif-bearing peptides that are identified as described herein are selected to confirm in vitro immunogenicity. Confirmation is performed using the following methodology:

Target Cell Lines for Cellular Screening:

The .221A2.1 cell line, produced by transferring the HLA-A2.1 gene into the HLA-A, -B. -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 μg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating $10\times10^6$ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® M-450) and the detacha-bead® reagent. Typically about $200-250\times10^6$ PBMC are processed to obtain $24\times10^6$ CD8+ T-cells (enough for a 48-well plate culture). Briefly, the PBMCs are thawed in RPMI with 30 μg/ml DNAse, washed once with PBS containing 1% human AB serum and resuspended in PBS/1% AB serum at a concentration of $20\times10^6$ cells/ml. The magnetic beads are washed 3 times with PBS/AB serum, added to the cells (140 μl beads/ $20\times10^6$ cells) and incubated for 1 hour at 4° C. with continuous mixing. The beads and cells are washed 4× with PBS/AB serum to remove the nonadherent cells and resuspended at $100\times10^6$ cells/ml (based on the original cell number) in PBS/AB serum containing 100 μl/ml detacha-bead® reagent and 30 μg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 57 minutes, washed once with PBS with 1% BSA, counted and pulsed with 40 μg/ml of peptide at a cell concentration of $1-2\times10^6$/ml in the presence of 3 μg/ml $\beta_2$-microglobulin for 4 hours at 20° C. The DC are then irradiated (4,200 rads), washed 1 time with medium and counted again.

Setting up induction cultures: 0.25 ml cytokine-generated DC (at $1\times10^5$ cells/ml) are co-cultured with 0.25 ml of CD8+ T-cells (at $2\times10^6$ cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at $5\times10^6$ cells/ml and irradiated at ~4200 rads. The PBMCs are plated at $2\times10^6$ in 0.5 ml complete medium per well and incubated for 2 hours at 37° C. The plates are washed twice with RPMI by tapping the plate gently to remove the nonadherent cells and the adherent cells pulsed with 10 μg/ml of peptide in the presence of 3 μg/ml β$_2$ microglobulin in 0.25 ml RPMI/5%AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL2 is added the next day and again 2-3 days later at 50 IU/ml (Tsai et al, *Critical Reviews in Immunology* 18(1-2):65-75, 1998). Seven days later, the cultures are assayed for CTL activity in a $^{51}$Cr release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL Lytic Activity by $^{51}$Cr Release.

Seven days after the second restimulation, cytotoxicity is determined in a standard (5 hr) $^{51}$Cr release assay by assaying individual wells at a single E:T. Peptide-pulsed targets are prepared by incubating the cells with 10 μg/ml peptide overnight at 37° C.

Adherent target cells are removed from culture flasks with trypsin-EDTA. Target cells are labeled with 200 μCi of $^{51}$Cr sodium chromate (Dupont, Wilmington, Del.) for 1 hour at 37° C. Labeled target cells are resuspended at 10$^6$ per ml and diluted 1:10 with K562 cells at a concentration of 3.3×10$^6$/ml (an NK-sensitive erythroblastoma cell line used to reduce non-specific lysis). Target cells (100 μl) and effectors (100 μl) are plated in 96 well round-bottom plates and incubated for 5 hours at 37° C. At that time, 100 μl of supernatant are collected from each well and percent lysis is determined according to the formula:

[(cpm of the test sample–cpm of the spontaneous $^{51}$Cr release sample)/(cpm of the maximal $^{51}$Cr release sample–cpm of the spontaneous $^{51}$Cr release sample)]×100.

Maximum and spontaneous release are determined by incubating the labeled targets with 1% Triton X-100 and media alone, respectively. A positive culture is defined as one in which the specific lysis (sample-background) is 10% or higher in the case of individual wells and is 15% or more at the two highest E:T ratios when expanded cultures are assayed.

In situ Measurement of Human IFNγ Production as an Indicator of Peptide-specific and Endogenous Recognition Immulon 2 plates are coated with mouse anti-human IFNγ monoclonal antibody (4 μg/ml 0.1M NaHCO$_3$, pH8.2) overnight at 4° C. The plates are washed with Ca$^{2+}$, Mg$^{2+}$-free PBS/0.05% Tween 20 and blocked with PBS/10% FCS for two hours, after which the CTLs (100 μl/well) and targets (100 μl/well) are added to each well, leaving empty wells for the standards and blanks (which received media only). The target cells, either peptide-pulsed or endogenous targets, are used at a concentration of 1×10$^6$ cells/ml. The plates are incubated for 48 hours at 37° C. with 5% CO$_2$.

Recombinant human IFN-gamma is added to the standard wells starting at 400 pg or 1200 pg/100 microliter/well and the plate incubated for two hours at 37° C. The plates are washed and 100 μl of biotinylated mouse anti-human IFN-gamma monoclonal antibody (2 microgram/ml in PBS/3%FCS/0.05% Tween 20) are added and incubated for 2 hours at room temperature. After washing again, 100 microliter HRP-streptavidin (1:4000) are added and the plates incubated for one hour at room temperature. The plates are then washed 6× with wash buffer, 100 microliter/well developing solution (TMB 1:1) are added, and the plates allowed to develop for 5-15 minutes. The reaction is stopped with 50 microliter/well 1M H$_3$PO$_4$ and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, 5×10$^4$ CD8+ cells are added to a T25 flask containing the following: 1×10$^6$ irradiated (4,200 rad) PBMC (autologous or allogeneic) per ml, 2×10$^5$ irradiated (8,000 rad) EBV-transformed cells per ml, and OKT3 (anti-CD3) at 30 ng per ml in RPMI-1640 containing 10% (v/v) human AB serum, non-essential amino acids, sodium pyruvate, 25 μM 2-mercaptoethanol, L-glutamine and penicillin/streptomycin. Recombinant human IL2 is added 24 hours later at a final concentration of 200 IU/ml and every three days thereafter with fresh media at 50 IU/ml. The cells are split if the cell concentration exceeds 1×10$^6$/ml and the cultures are assayed between days 13 and 15 at E:T ratios of 30, 10, 3 and 1:1 in the $^{51}$Cr release assay or at 1×10$^6$/ml in the in situ IFNγ assay using the same targets as before the expansion.

Cultures are expanded in the absence of anti-CD3+ as follows. Those cultures that demonstrate specific lytic activity against peptide and endogenous targets are selected and 5×10$^4$ CD8+ cells are added to a T25 flask containing the following: 1×10$^6$ autologous PBMC per ml which have been peptide-pulsed with 10 μg/ml peptide for two hours at 37° C. and irradiated (4,200 rad); 2×10$^5$ irradiated (8,000 rad) EBV-transformed cells per ml RPMI-1640 containing 10%(v/v) human AB serum, non-essential M, sodium pyruvate, 25 mM 2-ME, L-glutamine and gentamicin.

Immunogenicity of A2 Supermotif-Bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses 109P1D4. Briefly, PBMCs are isolated from patients, re-simulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogenicity

Immunogenicity screening of the B7-supertype cross-reactive binding peptides identified as set forth herein are confirmed in a manner analogous to the confirmation of A2- and A3-supermotif-bearing peptides.

Peptides bearing other supermotifs/motifs, e.g., HLA-A1, HLA-A24 etc. are also confirmed using similar methodology Example 15

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, l, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analoged to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an $IC_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci. USA* 92:8166, 1995).

In the cellular screening of these peptide analogs, it is important to confirm that analog-specific CTLs are also able to recognize the wild-type peptide and, when possible, target cells that endogenously express the epitope.

Analoging of HLA-A3 and B7-Supermotif-Bearing Peptides

Analogs of HLA-A3 supermotif-bearing epitopes are generated using strategies similar to those employed in analoging HLA-A2 supermotif-bearing peptides. For example, peptides binding to 3/5 of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (*J. Immunol.* 157:3480-3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position 1 is analyzed. The peptide is then analoged to, for example, substitute L for F at position 1. The analoged peptide is evaluated for increased binding affinity, binding half life and/or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analoged peptides are additionally tested for the ability to stimulate a recall response using PBMC from patients with 109P1D4-expressing tumors.

Other Analoging Strategies

Another form of peptide analoging, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 16

Identification and Confirmation of 109P1D4-Derived Sequences with HLA-DR Binding Motifs Peptide epitopes bearing an HLA class II supermotif or motif are identified and confirmed as outlined below using methodology similar to that described for HLA Class I peptides.

Selection of HLA-DR-Supermotif-Bearing Epitopes.

To identify 109P1D4-derived, HLA class II HTL epitopes, a 109P1D4 antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., *J. Immunol.* 160: 3363-3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The 109P1D4-derived peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2 β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. 109P1D4-derived peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, target 109P1D4 antigens are analyzed for sequences carrying one of the two DR3-specific binding motifs reported by Geluk et al. (*J. Immunol* 152:5742-5748, 1994). The corresponding peptides are then synthesized and confirmed as having the ability to bind DR3 with an affinity of 1 µM or better, i.e., less than 1 µM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 17

Immunogenicity of 109P1D4-Derived HTL Epitopes

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.) in vitro primary induction using normal PBMC or 2.) recall responses from patients who have 109P1D4-expressing tumors.

Example 18

Calculation of Phenotypic Frequencies of HLA-Supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae $gf=1-(SQRT(1-af))$ (see, e.g., Sidney et al., *Human Immunol.* 45:79-93, 1996). To obtain overall phenotypic frequencies, cumulative gene frequencies are calculated, and the cumulative antigen frequencies derived by the use of the inverse formula $[af=1-(1-Cgf)^2]$.

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%, see, e.g., Table IV (G). An analogous approach can be used to estimate population coverage achieved with combinations of class II motif-bearing epitopes.

Immunogenicity studies in humans (e.g., Bertoni et al., *J. Clin. Invest.* 100:503,1997; Doolan et al., *Immunity* 7:97, 1997; and Threlkeld et al., *J. Immunol.* 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 19

CTL Recognition of Endogenously Processed Antigens after Priming

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/K$^b$ target cells in the absence or presence of peptide, and also tested on $^{51}$Cr labeled target cells bearing the endogenously synthesized antigen, i.e. cells that are stably transfected with 109P1D4 expression vectors.

The results demonstrate that CTL lines obtained from animals primed with peptide epitope recognize endogenously synthesized 109P1D4 antigen. The choice of transgenic mouse model to be used for such an analysis depends upon the epitope(s) that are being evaluated. In addition to HLA-A*0201/K$^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 20

Activity of CTL-HTL Conjugated Epitopes in Transgenic Mice

This example illustrates the induction of CTLs and HTLs in transgenic mice, by use of a 109P1D4-derived CTL and HTL peptide vaccine compositions. The vaccine composition used herein comprise peptides to be administered to a patient with a 109P1D4-expressing tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al., *J. Immunol.* 159:4753-4761, 1997). For example, A2/K$^b$ mice, which are transgenic for the human HLA A2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTL/HTL conjugate, in DMSO/saline, or if the peptide composition is a polypeptide, in PBS or Incomplete Freund's Adjuvant. Seven days after priming, splenocytes obtained from these animals are restimulated with syngeneic irradiated LPS-activated lymphoblasts coated with peptide.

Cell lines: Target cells for peptide-specific cytotoxicity assays are Jurkat cells transfected with the HLA-A2.1/K$^b$ chimeric gene (e.g., Vibello et al., *J. Exp. Med.* 173:1007, 1991)

In vitro CTL activation: One week after priming, spleen cells ($30 \times 10^6$ cells/flask) are co-cultured at 37° C. with syngeneic, irradiated (3000 rads), peptide coated lymphoblasts ($10 \times 10^6$ cells/flask) in 10 ml of culture medium/T25 flask. After six days, effector cells are harvested and assayed for cytotoxic activity.

Assay for cytotoxic activity: Target cells (1.0 to $1.5 \times 10^6$) are incubated at 37° C. in the presence of 200 µl of $^{51}$Cr. After 60 minutes, cells are washed three times and resuspended in R10 medium. Peptide is added where required at a concentration of 1 µg/ml. For the assay, $10^4$ $^{51}$Cr-labeled target cells are added to different concentrations of effector cells (final volume of 200 µl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}$Cr release data is expressed as lytic units/$10^6$ cells. One lytic unit is arbitrarily defined as the number of effector cells required to achieve 30% lysis of 10,000 target cells in a six hour $^{51}$Cr release assay. To obtain specific lytic units/$10^6$, the lytic units/$10^6$ obtained in the absence of peptide is subtracted from the lytic units/$10^6$ obtained in the presence of peptide. For example, if 30% $^{51}$Cr release is obtained at the effector (E): target (T) ratio of 50:1 (i.e., $5 \times 10^5$ effector cells for 10,000 targets) in the absence of peptide and 5:1 (i.e., $5 \times 10^4$ effector cells for 10,000 targets) in the presence of peptide, the specific lytic units would be: [(1/50,000)−(1/500,000)]×$10^6$=18 LU.

The results are analyzed to assess the magnitude of the CTL responses of animals injected with the immunogenic CTL/HTL conjugate vaccine preparation and are compared to the magnitude of the CTL response achieved using, for example, CTL epitopes as outlined above in the Example entitled "Confirmation of Immunogenicity." Analyses similar to this may be performed to confirm the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 21

Selection of CTL and HTL Epitopes for Inclusion in a 109P1D4Specific Vaccine This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are selected which, upon administration, mimic immune responses that are correlated with 109P1D4 clearance. The number of epitopes used depends on observations of patients who spontaneously clear 109P1D4. For example, if it has been observed that patients who spontaneously clear 109P1D4-expressing cells generate an immune response to at least three (3) epitopes from 109P1D4 antigen, then at least three epitopes should be included for HLA class I. A similar rationale is used to determine HLA class II epitopes.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores from the BIMAS web site, at URL bimas.dcrt.nih.gov/.

In order to achieve broad coverage of the vaccine through out a diverse population, sufficient supermotif bearing peptides, or a sufficient array of allele-specific motif bearing peptides, are selected to give broad population coverage. In one embodiment, epitopes are selected to provide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, ie., it has a high concentration of epitopes. Epitopes may be nested or overlapping (i.e., frame shifted relative to one another); For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in 109P1D4, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress 109P1D4.

Example 22

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived 109P1D4, are selected such that multiple supermotifs/motifs are represented to ensure broad population coverage. Similarly, HLA class II epitopes are selected from 109P1D4 to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 µg of each of two oligonucleotides are annealed and extended: In an example using eight oligonucleotides, i.e., four pairs of primers, oligonucleotides 1+2, 3+4, 5+6, and 7+8 are combined in 100 µl reactions containing Pfu polymerase buffer (1×=10 mM KCL, 10 mM $(NH4)_2SO_4$, 20 mM Tris-chloride, pH 8.75, 2 mM MgSO4, 0.1% Triton X-100, 100 µg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 23

The Plasmid Construct and the Degree to which It Induces Immunogenicity

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683-692, 1996; Demotz et al., Nature 342:682-684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567-576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751-761, 1994.

For example, to confirm the capacity of a DNA minigene construct containing at least one HLA-A2 supermotif peptide to induce CTLs in vivo, HLA-A2.1/$K^b$ transgenic mice, for example, are immunized intramuscularly with 100 µg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}$Cr release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, I-$A^b$-restricted mice, for example, are immunized intramuscularly with 100 µg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al. *Immunity* 1:751-761, 1994). The results indicate the magnitude of the HTL response, thus demonstrating the in vivo immunogenicity of the minigene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299-S309, 1998) or recombinant vaccinia, for example, expressing a minigene or DNA encoding the complete protein of interest (see, e.g., Hanke et al, *Vaccine* 16:439-445, 1998; Sedegah et al., *Proc. Natl. Acad. Sci USA* 95:7648-53, 1998; Hanke and McMichael, *Immunol Letters* 66:177-181, 1999; and Robinson et al, *Nature Med.* 5:526-34, 1999).

For example, the efficacy of the DNA minigene used in a prime boost protocol is initially evaluated in transgenic mice. In this example, A2.1/$K^b$ transgenic mice are immunized IM with 100 µg of a DNA minigene encoding the immunogenic peptides including at least one HLA-A2 supermotif-bearing peptide. After an incubation period (ranging from 3-9 weeks), the mice are boosted IP with $10^7$ pfu/mouse of a recombinant vaccinia virus expressing the same sequence encoded by the DNA minigene. Control mice are immunized with 100 µg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 24

Peptide Compositions for Prophylactic Uses

Vaccine compositions of the present invention can be used to prevent 109P1D4 expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a 109P1D4-associated tumor.

For example, a peptide-based composition is provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 µg, generally 100-5,000 µg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against 109P1D4-associated disease.

Alternatively, a composition typically comprising transfecting agents is used for the administration of a nucleic acid-based vaccine in accordance with methodologies known in the art and disclosed herein.

Example 25

Polyepitopic Vaccine Compositions Derived from Native 109P1D4 Sequences

A native 109P1D4 polyprotein sequence is analyzed, preferably using computer algorithms defined for each class I and/or class II supermotif or motif, to identify "relatively short" regions of the polyprotein that comprise multiple epitopes. The "relatively short" regions are preferably less in length than an entire native antigen. This relatively short sequence that contains multiple distinct or overlapping, "nested" epitopes can be used to generate a minigene construct. The construct is engineered to express the peptide, which corresponds to the native protein sequence. The “relatively short” peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 10-mer epitope can be present in a 10 amino acid peptide. Such a vaccine composition is administered for therapeutic or prophylactic purposes.

The vaccine composition will include, for example, multiple CTL epitopes from 109P1D4 antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally, such an embodiment provides for the possibility of motif-bearing epitopes for an HLA makeup(s) that is presently unknown. Furthermore, this embodiment (excluding an analoged embodiment) directs the immune response to multiple peptide sequences that are actually present in native 109P1D4, thus avoiding the need to evaluate any junctional epitopes. Lastly, the embodiment provides an economy of scale when producing peptide or nucleic acid vaccine compositions.

Related to this embodiment, computer programs are available in the art which can be used to identify in a target sequence, the greatest number of epitopes per sequence length.

Example 26

Polyepitopic Vaccine Compositions from Multiple Antigens

The 109P1D4 peptide epitopes of the present invention are used in conjunction with epitopes from other target tumor-associated antigens, to create a vaccine composition that is useful for the prevention or treatment of cancer that expresses 109P1D4 and such other antigens. For example, a vaccine composition can be provided as a single polypeptide that incorporates multiple epitopes from 109P1D4 as well as tumor-associated antigens that are often expressed with a target cancer associated with 109P1D4 expression, or can be administered as a composition comprising a cocktail of one or more discrete epitopes. Alternatively, the vaccine can be administered as a minigene construct or as dendritic cells which have been loaded with the peptide epitopes in vitro.

Example 27

Use of Peptides to Evaluate an Immune Response

Peptides of the invention may be used to analyze an immune response for the presence of specific antibodies, CTL or HTL directed to 109P1 D4. Such an analysis can be performed in a manner described by Ogg et al., *Science* 279: 2103-2106, 1998. In this Example, peptides in accordance with the invention are used as a reagent for diagnostic or prognostic purposes, not as an immunogen.

In this example highly sensitive human leukocyte antigen tetrameric complexes (“tetramers”) are used for a cross-sectional analysis of, for example, 109P1D4 HLA-A*0201-specific CTL frequencies from HLA A*0201-positive individuals at different stages of disease or following immunization comprising a 109P1D4 peptide containing an A*0201 motif. Tetrameric complexes are synthesized as described (Musey et al., *N. Engl. J. Med.* 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma. St. Louis, Mo.), adenosine 5' phosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 μl of cold phosphate-buffered saline. Tricolor analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the 109P1D4 epitope, and thus the status of exposure to 109P1D4, or exposure to a vaccine that elicits a protective or therapeutic response.

Example 28

Use of Peptide Epitopes to Evaluate Recall Responses

The peptide epitopes of the invention are used as reagents to evaluate T cell responses, such as acute or recall responses, in patients. Such an analysis may be performed on patients who have recovered from 109P1D4-associated disease or who have been vaccinated with a 109P1D4 vaccine.

For example, the class I restricted CTL response of persons who have been vaccinated may be analyzed. The vaccine may be any 109P1D4 vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 µg/ml), and Hepes (10 mM) containing 10% heat-inactivated human AB serum (complete RPMI) and plated using microculture formats. A synthetic peptide comprising an epitope of the invention is added at 10 µg/ml to each well and HBV core 128-140 epitope is added at 1 µg/ml to each well as a source of T cell help during the first week of stimulation.

In the microculture format, 4×10$^5$ PBMC are stimulated with peptide in 8 replicate cultures in 96-well round bottom plate in 100 µ/well of complete RPMI. On days 3 and 10, 100 µl of complete RPMI and 20 U/ml final concentration of rIL-2 are added to each well. On day 7 the cultures are transferred into a 96-well flat-bottom plate and restimulated with peptide, rIL-2 and 10$^5$ irradiated (3,000 rad) autologous feeder cells. The cultures are tested for cytotoxic activity on day 14. A positive CTL response requires two or more of the eight replicate cultures to display greater than 10% specific $^{51}$Cr release, based on comparison with non-diseased control subjects as previously described (Rehermann, et al., *Nature Med.* 2:1104,1108, 1996; Rehermann et al., *J. Clin. Invest.* 97:1655-1665, 1996; and Rehermann et al. *J. Clin. Invest.* 98:1432-1440,1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670-2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 µM, and labeled with 100 µCi of $^{51}$ Cr (Amersham Corp., Arlington Heights, Ill.) for 1 hour after which they are washed four times with HBSS.

Cytolytic activity is determined in a standard 4-h, split well $^{51}$ Cr release assay using U-bottomed 96 well plates containing 3,000 targets/well. Stimulated PBMC are tested at effector/target (E/T) ratios of 20-50:1 on day 14. Percent cytotoxicity is determined from the formula: 100×[(experimental release–spontaneous release)/maximum release–spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to 109P1D4 or a 109P1D4 vaccine.

Similarly, Class II restricted HTL responses may also be analyzed. Purified PBMC are cultured in a 96-well flat bottom plate at a density of 1.5×10$^5$ cells/well and are stimulated with 10 µg/ml synthetic peptide of the invention, whole 109P1D4 antigen, or PHA. Cells are routinely plated in replicates of 4-6 wells for each condition. After seven days of culture, the medium is removed and replaced with fresh medium containing 10 U/ml IL-2. Two days later, 1 µCi $^3$H-thymidine is added to each well and incubation is continued for an additional 18 hours. Cellular DNA is then harvested on glass fiber mats and analyzed for $^3$H-thymidine incorporation. Antigen-specific T cell proliferation is calculated as the ratio of $^3$H-thymidine incorporation in the presence of antigen divided by the $^3$H-thymidine incorporation in the absence of antigen.

Example 29

Induction of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 µg of peptide composition;

Group II: 3 subjects are injected with placebo and 6 subjects are injected with 50 µpeptide composition;

Group III: 3 subjects are injected with placebo and 6 subjects are injected with 500 µg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 30

Phase II Trials in Patients Expressing 109P1D4

Phase II trials are performed to study the effect of administering the CTL-HTL peptide compositions to patients having cancer that expresses 109P1D4. The main objectives of the trial are to determine an effective dose and regimen for inducing CTLs in cancer patients that express 109P1D4, to establish the safety of inducing a CTL and HTL response in these patents, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21-65 and represent diverse ethnic backgrounds. All of them have a tumor that expresses 109P1D4.

Clinical manifestations or antigen-specific T-cell responses are monitored to assess the effects of administering the peptide compositions. The vaccine composition is found to be both safe and efficacious in the treatment of 109P1D4-associated disease.

Example 31

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of "Minigene" Multi-Epitope DNA Plasmids" in the form of naked nucleic acid administered IM (or SC or ID) in the amounts of 0.5-5 mg at multiple sites. The nucleic acid (0.1 to 1000 μg) can also be administer using a gene gun. Following an incubation period of 3-4 weeks, a booster dose is then administered. The booster can be recombinant fowfpox virus administered at a dose of $5\text{-}10^7$ to $5\times10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against 109P1D4 is generated.

Example 32

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction, respectively, of the target cells that bear the 109P1D4 protein from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although $2\text{-}50\times10^6$ DC per patient are typically administered, larger number of DC, such as $10^7$ or $10^8$ can also be provided. Such cell populations typically contain between 50-90% DC.

In some embodiments, peptide-loaded PBMC are injected into patients without purification of the DC. For example, PBMC generated after treatment with an agent such as ProgenipoietinTm are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive $5\times10^6$ DC, then the patient will be injected with a total of $2.5\times10^8$ peptide-loaded PBMC. The percent DC mobilized by an agent such as Progenipoietin™ is typically estimated to be between 2-10%, but can vary as appreciated by one of skill in the art.

Ex Vivo Activation of CTL/HTL Responses

Alternatively, ex vivo CTL or HTL responses to 109P1D4 antigens can be induced by incubating, in tissue culture, the patient's, or genetically compatible, CTL or HTL precursor cells together with a source of APC, such as DC, and immunogenic peptides. After an appropriate incubation time (typically about 7-28 days), in which the precursor cells are activated and expanded into effector cells, the cells are infused into the patient, where they will destroy (CTL) or facilitate destruction (HTL) of their specific target cells, ie., tumor cells.

Example 33

An Alternative Method of Identifying and Confirming Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigen of interest, e.g. 109P1D4. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J.*

*Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode 109P1D4 to isolate peptides corresponding to 109P1D4 that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 34

Complementary Polynucleotides

Sequences complementary to the 109P1D4-encoding sequences, or any parts thereof, are used to detect, decrease, or inhibit expression of naturally occurring 109P1D4. Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequence of 109P1D4. To inhibit transcription, a complementary oligonucleotide is designed from the most unique 5' sequence and used to prevent promoter binding to the coding sequence. To inhibit translation, a complementary oligonucleotide is designed to prevent ribosomal binding to a 109P1D4-encoding transcript.

Example 35

Purification of Naturally-Occurring or Recombinant 109P11D4 Using 109P1D4-Specific Antibodies Naturally occurring or recombinant 109P1D4 is substantially purified by immunoaffinity chromatography using antibodies specific for 109P1D4. An immunoaffinity column is constructed by covalently coupling anti-109P1D4 antibody to an activated chromatographic resin, such as CNBr-activated SEPHAROSE (Amersham Pharmacia Biotech). After the coupling, the resin is blocked and washed according to the manufacturers instructions.

Media containing 109P1D4 are passed over the immunoaffinity column, and the column is washed under conditions that allow the preferential absorbance of 109P1D4 (e.g., high ionic strength buffers in the presence of detergent). The column is eluted under conditions that disrupt antibody/109P1D4 binding (e.g., a buffer of pH 2 to pH 3, or a high concentration of a chaotrope, such as urea or thiocyanate ion), and GCR.P is collected.

Example 36

Identification of Molecules which Interact with 109P1D4

109P1D4, or biologically active fragments thereof, are labeled with 121 1 Bolton-Hunter reagent. (See, e.g., Bolton et al. (1973) Biochem. J. 133:529.) Candidate molecules previously arrayed in the wells of a multi-well plate are incubated with the labeled 109P1D4, washed, and any wells with labeled 109P1D4 complex are assayed. Data obtained using different concentrations of 109P1D4 are used to calculate values for the number, affinity, and association of 109P1D4 with the candidate molecules.

Example 37

In Vivo Assay for 109P1D4 Tumor Growth Promotion

The effect of a 109P1D4 protein on tumor cell growth is evaluated in vivo by gene overexpression in tumor-bearing mice. For example, SCID mice are injected subcutaneously on each flank with $1\times10^6$ of either PC3, DU145 or 3T3 cells containing tkNeo empty vector or a nucleic acid sequence of the invention. At least two strategies can be used: (1) Constitutive expression under regulation of a promoter such as a constitutive promoter obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), or from heterologous mammalian promoters, e.g., the actin promoter or an immunoglobulin promoter, provided such promoters are compatible with the host cell systems, and (2) Regulated expression under control of an inducible vector system, such as ecdysone, tet, etc., provided such promoters are compatible with the host cell systems. Tumor volume is then monitored at the appearance of palpable tumors and followed over time to determine if the cells expressing a gene of the invention grow at a faster rate and whether tumors of a 109P1D4 protein-expressing cells demonstrate characteristics of altered aggressiveness (e.g. enhanced metastasis, vascularization, reduced responsiveness to chemotherapeutic drugs).

Additionally, mice can be implanted with $1\times10^5$ of the same cells orthotopically to determine if a protein of the invention has an effect on local growth in the prostate or on the ability of the cells to metastasize, specifically to lungs, lymph nodes, and bone marrow.

The assay is also useful to determine the inhibitory effect of candidate therapeutic compositions, such as for example, 109P1D4 protein-related intrabodies, 109P1D4 gene-related antisense molecules and ribozymes.

Example 38

109P1D4 Monoclonal Antibody-Mediated Inhibition of Tumors In Vivo

The significant expression of 109P1D4 proteins in the cancer tissues of Table I and its restrictive expression in normal tissues, together with its expected cell surface expression, makes 109P1D4 proteins excellent targets for antibody therapy. Similarly, 109P1D4 proteins are a target for T cell-based immunotherapy. Thus, for 109P1D4 genes expressed, e.g., in prostate cancer, the therapeutic efficacy of anti-109P1D4 protein mAbs in human prostate cancer xenograft mouse models is evaluated by using androgen-independent LAPC-4 and LAPC-9 xenografts (Craft, N., et al., Cancer Res, 1999. 59(19): p. 5030-6) and the androgen independent recombinant cell line PC3-of 109P1D4 (see, e.g., Kaighn, M. E., et al., Invest Urol, 1979. 17(1): p. 16-23); analogous models are used for other cancers.

Antibody efficacy on tumor growth and metastasis formation is studied, e.g., in a mouse orthotopic prostate cancer xenograft models and mouse kidney xenograft models. The antibodies can be unconjugated, as discussed in this Example, or can be conjugated to a therapeutic modality, as appreciated in the art. Anti-109P1D4 protein mAbs inhibit formation of both the androgen-dependent LAPC-9 and androgen-independent PC3-109P1D4 protein tumor xenografts. Anti-109P1D4 protein mAbs also retard the growth of established orthotopic tumors and prolonged survival of tumor-bearing mice. These results indicate the utility of anti-109P1D4 protein mAbs in the treatment of local and advanced stages of prostate cancer.

Administration of the anfi-109P1D4 protein mAbs lead to retardation of established orthotopic tumor growth and inhibition of metastasis to distant sites, resulting in a significant prolongation in the survival of tumor-bearing mice. These studies indicate that proteins of the invention are attractive targets for immunotherapy and demonstrate the therapeutic potential of anti-109P1D4 protein mAbs for the treatment of local and metastatic cancer. This example demonstrates that unconjugated 109P1D4 protein-related monoclonal antibodies are effective to inhibit the growth of human prostate tumor xenografts and human kidney xenografts grown in SCID mice; accordingly a combination of such efficacious monoclonal antibodies is also effective.

Tumor Inhibition Using Multiple Unconjugated mAbs
Materials and Methods
109P1D4 Protein-Related Monoclonal Antibodies:

Monoclonal antibodies are raised against proteins of the invention as described in the Example entitled "Generation of 109P1D4 Monoclonal Antibodies". The antibodies are characterized by ELISA, Western blot, FACS, and immunoprecipitation for their capacity to bind to the respective protein of the invention. Epitope mapping data for, e.g., the anti-109P1D4 protein mAbs, as determined by ELISA and Western analysis, indicate that the antibodies recognize epitopes on the respective 109P1D4 protein. Immunohistochemical analysis of prostate cancer tissues and cells with these antibodies is performed.

The monoclonal antibodies are purified from ascites or hybridoma tissue culture supernatants by Protein-G Sepharose chromatography, dialyzed against PBS, filter sterilized, and stored at −20° C. Protein determinations are performed by a Bradford assay (Bio-Rad, Hercules, Calif.). A therapeutic monoclonal antibody or a cocktail comprising a mixture of individual monoclonal antibodies is prepared and used for the treatment of mice receiving subcutaneous or orthotopic injections of LAPC-9 prostate tumor xenografts.

Cancer Xenografts and Cell Lines

The LAPC-9 xenograft, which expresses a wild-type androgen receptor and produces prostate-specific antigen (PSA), is passaged in 6- to 8-week-old male ICR-severe combined immunodeficient (SCID) mice (Taconic Farms) by s.c. trocar implant (Craft, N., et al., supra). The prostate carcinoma cell line PC3 (American Type Culture Collection) is maintained in RPMI supplemented with L-glutamine and 10% FBS.

Recombinant PC3 and 3T3-cell populations expressing a protein of the invention are generated by retroviral gene transfer as described in Hubert, R. S., et al., STEAP: a prostate-specific cell-surface antigen highly expressed in human prostate tumors. Proc Natl Acad Sci USA, 1999. 96(25): p. 14523-8. Anti-protein of the invention staining is detected by using an FITC-conjugated goat anti-mouse antibody (Southern Biotechnology Associates) followed by analysis on a Coulter Epics-XL flow cytometer.

Xenoqraft Mouse Models.

Subcutaneous (s.c.) tumors are generated by injection of $1\times10^6$ LAPC-9, PC3, recombinant PC3-protein of the invention, 3T3 or recombinant 3T3-protein of the invention cells mixed at a 1:1 dilution with Matrigel (Collaborative Research) in the right flank of male SCID mice. To test antibody efficacy on tumor formation, i.p. antibody injections are started on the same day as tumor-cell injections. As a control, mice are injected with either purified mouse IgG (ICN) or PBS; or a purified monoclonal antibody that recognizes an irrelevant antigen not expressed in human cells. In preliminary studies, no difference is found between mouse IgG or PBS on tumor growth. Tumor sizes are determined by vernier caliper measurements, and the tumor volume is calculated as length×width×height. Mice with s.c. tumors greater than 1.5 cm in diameter are sacrificed. PSA levels are determined by using a PSA ELISA kit (Anogen, Mississauga, Ontario). Circulating levels of, e.g., anti-109P1D4 protein mAbs are determined by a capture ELISA kit (Bethyl Laboratories, Montgomery, Tex.). (See, e.g., Saffran, D., et al., PNAS 10:1073-1078 or www.pnas.orglcgi/doi/10.1073/pnas.051624698)

Orthotopic injections are performed under anesthesia by using ketamine/xylazine. For prostate orthotopic studies, an incision is made through the abdominal muscles to expose the bladder and seminal vesicles, which then are delivered through the incision to expose the dorsal prostate. LAPC-9 or PC3 cells ($5\times10^5$) mixed with Matrigel are injected int dorsal lobe in a 10-µl volume. To monitor tumor growth, mice are bled on a weekly basis for determination of PSA levels. The mice are segregated into groups for the appropriate treatments, with anti-protein of the invention or control mAbs being injected i.p.

Anti-109P1D4 Protein mAbs Inhibit Growth of Respective 109P1D4 Protein-Expressing Xenograft-Cancer Tumors The effect of anti-109P1D4 protein mAbs on tumor formation is tested by using LAPC-9 and recombinant PC3-protein of the invention orthotopic models. As compared with the s.c. tumor model, the orthotopic model, which requires injection of tumor cells directly in the mouse prostate or kidney, respectively, results in a local tumor growth, development of metastasis in distal sites, deterioration of mouse health, and subsequent death (Saffran, D., et al., PNAS supra; Fu, X., et al., Int J Cancer, 1992. 52(6): p. 987-90; Kubota, T., J Cell Biochem, 1994. 56(1): p. 4-8). The features make the orthotopic model more representative of human disease progression and allowed us to follow the therapeutic effect of mAbs on clinically relevant end points.

Accordingly, tumor cells are injected into the mouse prostate or kidney, and 2 days later, the mice are segregated into two groups and treated with either: a) 200-500µg, of anti-109P1D4 protein Ab, or b) PBS three times per week for two to five weeks.

A major advantage of the orthotopic prostate-cancer model is the ability to study the development of metastases. Formation of metastasis in mice bearing established orthotopic tumors is studied by IHC analysis on lung sections using an antibody against a prostate-specific cell-surface protein STEAP expressed at high levels in LAPC-9 xenografts (Hubert, R. S., et al., Proc Natl Acad Sci USA, 1999. 96(25): p. 14523-8).

Mice bearing established orthotopic LAPC-9 or recombinant PC3-109P1D4 protein tumors are administered 1000 µg injections of either anti-109P1D4 protein mAbs or PBS over a 4-week period. Mice in both groups are allowed to establish a high tumor burden (PSA levels greater than 300 ng/ml for IAPC-9), to ensure a high frequency of metastasis formation in mouse lungs. Mice then are killed and their prostate and lungs are analyzed for the presence of tumor cells by IHC analysis.

These studies demonstrate a broad anti-tumor efficacy of anti-109P1D4 protein antibodies on initiation and progression of prostate cancer in xenograft mouse models. Anti-109P1D4 protein antibodies inhibit tumor formation of both androgen-dependent and androgen-independent tumors, retard the growth of already established tumors, and prolong the survival of treated mice. Moreover, anti-109P1D4 protein mAbs demonstrate a dramatic inhibitory effect on the spread of local prostate tumor to distal sites, even in the presence of a large tumor burden. Thus, anti-109P1D4 protein mAbs are efficacious on major clinically relevant end points (tumor growth), prolongation of survival, and health.

Example 39

Therapeutic and Diagnostic Use of Anti-109P1D4 Antibodies in Humans

Anti-109P1D4 monoclonal antibodies are safely and effectively used for diagnostic, prophylactic, prognostic and/or therapeutic purposes in humans. Western blot and immunohistochemical analysis of cancer tissues and cancer xenografts with anti-109P1D4 mAb show strong extensive staining in carcinoma but significantly lower or undetectable levels in normal tissues. Detection of 109P1D4 in carcinoma and in metastatic disease demonstrates the usefulness of the mAb as a diagnostic and/or prognostic indicator. Anti-109P1D4 antibodies are therefore used in diagnostic applications such as immunohistochemistry of kidney biopsy specimens to detect cancer from suspect patients.

As determined by flow cytometry, anti-109P1D4 mAb specifically binds to carcinoma cells. Thus, anti-109P1D4 antibodies are used in diagnostic whole body imaging applications, such as radioimmunoscintigraphy and radioimmunotherapy, (see, e.g., Potamianos S., et. al. Anticancer Res 20(2A):925-948 (2000)) for the detection of localized and metastatic cancers that exhibit expression of 109P1D4. Shedding or release of an extracellular domain of 109P1D4 into the extracellular milieu, such as that seen for alkaline phosphodiesterase B10 (Meerson, N. R., Hepatology 27:563-568 (1998)), allows diagnostic detection of 109P1D4 by anti-109P1D4 antibodies in serum and/or urine sample from suspect patients.

Anti-109P1D4 antibodies that specifically bind 109P1D4 are used in therapeutic applications for the treatment of cancers that express 109P1D4. Anti-109P1D4 antibodies are used as an unconjugated modality and as conjugated form in which the antibodies are attached to one of various therapeutic or imaging modalities well known in the art, such as a prodrugs, enzymes or radioisotopes. In preclinical studies, unconjugated and conjugated anti-109P1D4 antibodies are tested for efficacy of tumor prevention and growth inhibition in the SCID mouse cancer xenograft models e.g., kidney cancer models AGS-K3 and AGS-K6, (see, e.g., the Example entitled "109P1D4 Monoclonal Antibody-mediated Inhibition of Bladder and Lung Tumors In Vivo"). Either conjugated and unconjugated anti-109P1D4 antibodies are used as a therapeutic modality in human clinical trials either alone or in combination with other treatments as described in following Examples.

Example 40

Human Clinical Trials for the Treatment and Diagnosis of Human Carcinomas through Use of Human Anti-109P1D4 Antibodies In Vivo Antibodies are used in accordance with the present invention which recognize an epitope on 109P1D4, and are used in the treatment of certain tumors such as those listed in Table I. Based upon a number of factors, including 109P1D4 expression levels, tumors such as those listed in Table I are presently preferred indications. In connection with each of these indications, three clinical approaches are successfully pursued.

I.) Adjunctive therapy: In adjunctive therapy, patients are treated with anti-109P1D4 antibodies in combination with a chemotherapeutic or antineoplastic agent and/or radiation therapy. Primary cancer targets, such as those listed in Table I, are treated under standard protocols by the addition anti-109P1D4 antibodies to standard first and second line therapy. Protocol designs address effectiveness as assessed by reduction in tumor mass as well as the ability to reduce usual doses of standard chemotherapy. These dosage reductions allow additional and/or prolonged therapy by reducing dose-related toxicity of the chemotherapeutic agent. Anti-109P1D4 antibodies are utilized in several adjunctive clinical trials in combination with the chemotherapeutic or antineoplastic agents adriamycin (advanced prostrate carcinoma), cisplatin (advanced head and neck and lung carcinomas), taxol (breast cancer), and doxorubicin (preclinical).

II.) Monotherapy: In connection with the use of the anti-109P1D4 antibodies in monotherapy of tumors, the antibodies are administered to patients without a chemotherapeutic or antineoplastic agent. In one embodiment, monotherapy is conducted clinically in end stage cancer patients with extensive metastatic disease. Patients show some disease stabilization. Trials demonstrate an effect in refractory patients with cancerous tumors.

III.) Imaging Agent: Through binding a radionuclide (e.g., iodine or yttrium ($I^{131}$, $Y^{90}$) to anti-109P1D4 antibodies, the radiolabeled antibodies are utilized as a diagnostic and/or imaging agent. In such a role, the labeled antibodies localize to both solid tumors, as well as, metastatic lesions of cells expressing 109P1D4. In connection with the use of the anti-109P1D4 antibodies as imaging agents, the antibodies are used as an adjunct to surgical treatment of solid tumors, as both a pre-surgical screen as well as a post-operative follow-up to determine what tumor remains and/or returns. In one embodiment, a ($^{111}$In)-109P1D4 antibody is used as an imaging agent in a Phase I human clinical trial in patients having a carcinoma that expresses 109P1D4 (by analogy see, e.g., Divgi et al. *J. Natl. Cancer Inst.* 83:97-104 (1991)). Patients are followed with standard anterior and posterior gamma camera. The results indicate that primary lesions and metastatic lesions are identified.

Dose and Route of Administration

As appreciated by those of ordinary skill in the art, dosing considerations can be determined through comparison with the analogous products that are in the clinic. Thus, anti-109P1D4 antibodies can be administered with doses in the range of 5 to 400 mg/m 2, with the lower doses used, e.g., in connection with safety studies. The affinity of anti-109P1D4 antibodies relative to the affinity of a known antibody for its target is one parameter used by those of skill in the art for determining analogous dose regimens. Further, anti-109P1D4 antibodies that are fully human antibodies, as compared to the chimeric antibody, have slower clearance; accordingly, dosing in patients with such fully human anti- 109P1D4 antibodies can be lower, perhaps in the range of 50 to 300 mg/m², and still remain efficacious. Dosing in mg/m², as opposed to the conventional measurement of dose in mg/kg, is a measurement based on surface area and is a convenient dosing measurement that is designed to include patients of all sizes from infants to adults.

Three distinct delivery approaches are useful for delivery of anti-109P1D4 antibodies. Conventional intravenous delivery is one standard delivery technique for many tumors. However, in connection with tumors in the peritoneal cavity, such as tumors of the ovaries, biliary duct, other ducts, and the like, intraperitoneal administration may prove favorable for obtaining high dose of antibody at the tumor and to also minimize antibody clearance. In a similar manner, certain solid tumors possess vasculature that is appropriate for regional perfusion. Regional perfusion allows for a high dose of antibody at the site of a tumor and minimizes short term clearance of the antibody.

Clinical Development Plan (CDP)

Overview: The CDP follows and develops treatments of anti-109P1D4 antibodies in connection with adjunctive therapy, monotherapy, and as an imaging agent. Trials initially demonstrate safety and thereafter confirm efficacy in repeat doses. Trails are open label comparing standard chemotherapy with standard therapy plus anti-109P1D4 antibodies. As will be appreciated, one criteria that can be utilized in connection with enrollment of patients is 109P1D4 expression levels in their tumors as determined by biopsy.

As with any protein or antibody infusion-based therapeutic, safety concerns are related primarily to (i) cytokine release syndrome, i.e., hypotension, fever, shaking, chills; (ii) the development of an immunogenic response to the material (i.e., development of human antibodies by the patient to the antibody therapeutic, or HAHA response); and, (iii) toxicity to normal cells that express 109P1D4. Standard tests and follow-up are utilized to monitor each of these safety concerns. Anti-109P1D4 antibodies are found to be safe upon human administration.

Example 41

Human Clinical Trial Adjunctive Therapy with Human Anti-109P1D4 Antibody and Chemotherapeutic Agent A phase I human clinical trial is initiated to assess the safety of six intravenous doses of a human anti-109P1D4 antibody in connection with the treatment of a solid tumor, e.g., a cancer of a Ussue listed in Table I. In the study, the safety of single doses of anti-109P1D4 antibodies when utilized as an adjunctive therapy to an antineoplastic or chemotherapeutic agent as defined herein, such as, without limitation: cisplatin, topotecan, doxorubicin, adriamycin, taxol, or the like, is assessed. The trial design includes delivery of six single doses of an anti-109P1D4 antibody with dosage of antibody escalating from approximately about 25 mg/m² to about 275 mg/m² over the course of the treatment in accordance with the following schedule:

|  | Day 0 | Day 7 | Day 14 | Day 21 | Day 28 | Day 35 |
| --- | --- | --- | --- | --- | --- | --- |
| mAb Dose | 25 mg/m² | 75 mg/m² | 125 mg/m² | 175 mg/m² | 225 mg/m² | 275 mg/m² |
| Chemotherapy (standard dose) | + | + | + | + | + | + |

Patients are closely followed for one-week following each administration of antibody and chemotherapy. In particular, patients are assessed for the safety concerns mentioned above: (i) cytokine release syndrome, i.e., hypotension, fever, shaking, chills; (ii) the development of an immunogenic response to the material (i.e., development of human antibodies by the patient to the human antibody therapeutic, or HAHA response); and, (iii) toxicity to normal cells that express 109P1D4. Standard tests and follow-up are utilized to monitor each of these safety concerns. Patients are also assessed for clinical outcome, and particularly reduction in tumor mass as evidenced by MRI or other imaging.

The anti-109P1D4 antibodies are demonstrated to be safe and efficacious, Phase II trials confirm the efficacy and refine optimum dosing.

Example 42

Human Clinical Trial: Monotherapy with Human Anti-109P1D4 Antibody

Anti-109P1D4 antibodies are safe in connection with the above-discussed adjunctive trial, a Phase II human clinical trial confirms the efficacy and optimum dosing for monotherapy. Such trial is accomplished, and entails the same safety and outcome analyses, to the above-described adjunctive trial with the exception being that patients do not receive chemotherapy concurrently with the receipt of doses of anti-109P1D4 antibodies.

Example 43

Human Clinical Trial: Diagnostic Imaging with Anti-109P1D4 Antibody

Once again, as the adjunctive therapy discussed above is safe within the safety criteria discussed above, a human clinical trial is conducted concerning the use of anti-109P1D4 antibodies as a diagnostic imaging agent. The protocol is designed in a substantially similar manner to those described in the art, such as in Divgi et al. *J. Natl. Cancer Inst.* 83:97-104(1991). The antibodies are found to be both safe and efficacious when used as a diagnostic modality.

Example 44

109P1D4 Functional Assays

I. Phosphorylation of 109P1D4 on Tyrosine Residues

One hallmark of the cancer cell phenotype is the active signal transduction of surface bound receptor molecules, such as the EGF receptor, through tyrosine phosphorylation of their cytoplasmic domains and their subsequent interaction with cytosolic signaling molecules. To address the possibility that 109P1D4 is phosphorylated on its cytoplamsic tyrosine residues, 293T cells were transfected with the 109P1D4 gene in an expression plasmid such that the 109P1D4 gene was fused with a Myc/His tag, and were then stimulated with pervanadate (a 1:1 mixture of $Na_3VO_4$ and $H_2O_2$). After solubilization of the cells in Triton X-100, the 109P1D4 protein was immunoprecipitated with anti-His polyclonal antibody (pAb), subjected to SDS-PAGE and Western blotted with anti-phosphotyrosine. Equivalent immunoprecipitates were Western blotted with anti-His antibody. In FIG. 22, 109P1D4 protein exhibits tyrosine phosphorylation only upon cell treatment with pervanadate and not without treatment. This suggests that pervanadate, which inhibits intracellular protein tyrosine phosphatases (PTPs), allows the accumulation of phosphotyrosine (tyrosine kinase activity) on 109P1D4. Further, a large amount of the 109P1D4 protein is sequestered into the insoluble fraction upon pervanadate activation, suggesting its association with cytoskeletal components. Similar effects of partial insolubility in Triton X-100 have been observed for cadherins, proteins that are related to protocadherins based on homology of their extracellular domains. Cadherins are known to interact with cytoskeletal proteins including actin, which are not readily soluble in the detergent conditions used in this study. Together, these data indicate that 109P1D4 is a surface receptor with the capacity to be phosphorylated on tyrosine and to bind to signaling molecules that possess SH2 or PTB binding domains, including but not limited to, phospholipase-Cγ1, Grb2, Shc, Crk, PI-3-kinase p85 subunit, rasGAP, Src-family kinases and abl-family kinases. Such interactions are important for downstream signaling through 109P1D4, leading to changes in adhesion, proliferation, migration or elaboration of secreted factors. In addition, 109P1D4 protein interacts with cytoskeletal components such as actin that facilitates its cell adhesion functions. These phenotypes are enhanced in 109P1D4 expressing tumor cells and contribute to their increased capacity to metastasize and grow in vivo.

Thus, when 109P1D4 plays a role in cell signaling and phosphorylation, it is used as a target for diagnostic, prognostic, preventative and/or therapeutic purposes.

Example 45

109P1D4 RNA Interference (RNAi)

RNA interference (RNAi) technology is implemented to a variety of cell assays relevant to oncology. RNAi is a post-transcriptional gene silencing mechanism activated by double-stranded RNA (dsRNA). RNAi induces specific mRNA degradation leading to changes in protein expression and subsequently in gene function. In mammalian cells, these dsRNAs called short interfering RNA (siRNA) have the correct composition to activate the RNAi pathway targeting for degradation, specifically some mRNAs. See, Elbashir S. M., et. al., *Duplexes of 21-nucleotide RNAs Mediate RNA interference in Cultured Mammalian Cells*, Nature 411(6836): 494-8 (2001). Thus, RNAi technology is used successfully in mammalian cells to silence targeted genes.

Loss of cell proliferation control is a hallmark of cancerous cells; thus, assessing the role of 109P1D4 in cell survival/proliferation assays is relevant. Accordingly, RNAi was used to investigate the function of the 109P1D4 antigen. To generate siRNA for 109P1D4, algorithms were used that predict oligonucleotides that exhibit the critical molecular parameters (G:C content, melting temperature, etc.) and have the ability to significantly reduce the expression levels of the 109P1D4 protein when introduced into cells. Accordingly, three targeted sequences for the 109P1D4 siRNA are: 5' AAGAGGATACTGGTGAGATCT 3' (SEQ ID NO: 57) (oligo 109P1D4. a), 5' AAGAGCAATGGTGCTGGTAAA 3' (SEQ ID NO: 58)(oligo 109P1D4. c), and 5' AACACCAGAAGGAGACAAGAT 3' (SEQ ID NO: 59)(oligo 109P1D4. d). In accordance with this Example, 109P1D4 siRNA compositions are used that comprise siRNA (double stranded, short interfering RNA) that correspond to the nucleic acid ORF sequence of the 109P1D4 protein or subsequences thereof. Thus, siRNA subsequences are used in this manner are generally 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more than 35 contiguous RNA nucleotides in length. These siRNA sequences are complementary and non-complementary to at least a portion of the mRNA coding sequence. In a preferred embodiment, the subsequences are 19-25 nucleotides in length, most preferably 21-23 nucleotides in length. In preferred embodiments, these siRNA achieve knockdown of 109P1D4 antigen in cells expressing the protein and have functional effects as described below.

The selected siRNAs (109P1D4. a, 109P1D4. c, 109P1D4. d oligos) were tested in LNCaP cells in the $^3$H-thymidine incorporation assay (measures cellular proliferation). Moreover, the oligonucleotides achieved knockdown of 109P1D4 antigen in cells expressing the protein and had functional effects as described below using the following protocols.

Mammalian siRNA transfections: The day before siRNA transfection, the different cell lines were plated in media (RPMI 1640 with 10% FBS w/o antibiotics) at 2×10$^3$ cells/well in 80μ (96 well plate format) for the proliferation assay. In parallel with the 109P1D4 specific siRNA oligo, the following sequences were included in every experiment as controls: a) Mock transfected cells with Lipofectamine 2000 (Invitrogen, Carlsbad, Calif.) and annealing buffer (no siRNA); b) Luciferase-4 specific siRNA (targeted sequence: 5'-AAGGGACGAAGACGAACACUUCTT-3') (SEQ ID NO: 60); and, c) Eg5 specific siRNA (targeted sequence: 5'-AACTGAAGACCTGAAGACAATAA-3') (SEQ ID NO: 61). SiRNAs were used at 10 nM and μg/ml Lipofectamine 2000 final concentration.

The procedure was as follows: The siRNAs were first diluted in OPTIMEM (serum-free transfection media, Invitrogen) at 0.1 μM (10-fold concentrated) and incubated 5-10 min RT. Lipofectamine 2000 was diluted at 10 μg/ml (10-fold concentrated) for the total number transfections and incubated 5-10 minutes at room temperature (RT). Appropriate amounts of diluted 10-fold concentrated Lipofectamine 2000 were mixed 1:1 with diluted 10-fold concentrated siRNA and incubated at RT for 20-30" (5-fold concentrated transfection solution). 20 μls of the 5-fold concentrated transfection solutions were added to the respective samples and incubated at 37° C. for 96 hours before analysis.

$^3$H-Thymidine incorporation assay: The proliferation assay is a $^3$H-thymidine incorporation method for determining the proliferation of viable cells by uptake and incorporation of label into DNA.

The procedure was as follows: Cells growing in log phase are trypsinized, washed, counted and plated in 96-well plates at 1000-4000 cells/well in 10% FBS. After 4-8 hrs, the media is replaced. The cells are incubated for 24-72 hrs, pulsed with $^3$H-Thy at 1.5 μCi/ml for 14 hrs, harvested onto a filtermat and counted in scintillation cocktail on a Microbeta trilux or other counter.

In order to address the function of 109P1D4 in cells, 109P1D4 was silenced by transfecting the endogenously expressing 109P1D4 cell line (LNCaP) with the 109P1D4 specific siRNAs (109P1D4. a, 109P1D4.c, and 109P1D4.d) along with negative siRNA controls (Luc4, targeted sequence not represented in the human genome), a positive siRNA control (targeting Eg5) and no siRNA oligo (LF2K) (FIG. 12). The results indicated that when these cells are treated with siRNA specifically targeting the 109P1D4 mRNA, the resulting "109P1D4 deficient cells" showed diminished cell proliferation as measured by this assay (e.g., see oligo 109P1D4. a treated cells).

These data indicate that 109P1D4 plays an important role in the proliferation of cancer cells and that the lack of 109P1D4 clearly decreases the survival potential of these cells. It is to be noted that 109P1D4 is constitutively expressed in many tumor cell lines. 109P1D4 serves a role in malignancy; its expression is a primary indicator of disease, where such disease is often characterized by high rates of uncontrolled cell proliferation and diminished apoptosis. Correlating cellular phenotype with gene knockdown following RNAi treatments is important, and allows one to draw valid conclusions and rule out toxicity or other non-specific effects of these reagents. To this end, assays to measure the levels of expression of both protein and mRNA for the target after RNAi treatments are important, including Western blotting, FACS staining with antibody, immunoprecipitation, Northern blotting or RT-PCR (Taqman or standard methods). Any phenotypic effect of the siRNAs in these assays should be correlated with the protein and/or mRNA knockdown levels in the same cell lines. 109P1D4 protein is reduced after treatment with siRNA oligos described above (e.g., 109P1D4. a, etc.)

A method to analyze 109P1D4 related cell proliferation is the measurement of DNA synthesis as a marker for proliferation. Labeled DNA precursors (i.e. $^3$H-Thymidine) are used and their incorporation to DNA is quantified. Incorporation of the labeled precursor into DNA is directly proportional to the amount of cell division occurring in the culture. Another method used to measure cell proliferation is performing clonogenic assays. In these assays, a defined number of cells are plated onto the appropriate matrix and the number of colonies formed after a period of growth following siRNA treatment is counted.

In 109P1D4 cancer target validation, complementing the cell survival/proliferation analysis with apoptosis and cell cycle profiling studies are considered. The biochemical hallmark of the apoptotic process is genomic DNA fragmentation, an irreversible event that commits the cell to die. A method to observe fragmented DNA in cells is the immunological detection of histone-complexed DNA fragments by an immunoassay (i.e. cell death detection ELISA) which measures the enrichment of histone-complexed DNA fragments (mono- and oligo-nucleosomes) in the cytoplasm of apoptotic cells. This assay does not require pre-labeling of the cells and can detect DNA degradation in cells that do not proliferate in vitro (i.e. freshly isolated tumor cells).

The most important effector molecules for triggering apoptotic cell death are caspases. Caspases are proteases that when activated cleave numerous substrates at the carboxy-terminal site of an aspartate residue mediating very early stages of apoptosis upon activation. All caspases are synthesized as pro-enzymes and activation involves cleavage at aspartate residues. In particular, caspase 3 seems to play a central role in the initiation of cellular events of apoptosis. Assays for determination of caspase 3 activation detect early events of apoptosis. Following RNAi treatments, Western blot detection of active caspase 3 presence or proteolytic cleavage of products (i.e. PARP) found in apoptotic cells further support an active induction of apoptosis. Because the cellular mechanisms that result in apoptosis are complex, each has its advantages and limitations. Consideration of other criteria/endpoints such as cellular morphology, chromatin condensation, membrane blebbing, apoptotic bodies help to further support cell death as apoptotic. Since not all the gene targets that regulate cell growth are anti-apoptotic, the DNA content of permeabilized cells is measured to obtain the profile of DNA content or cell cycle profile. Nuclei of apoptotic cells contain less DNA due to the leaking out to the cytoplasm (sub-G1 population). In addition, the use of DNA stains (i.e. propidium iodide) also differentiate between the different phases of the cell cycle in the cell population due to the presence of different quantities of DNA in G0/G1, S and G2/M. In these studies the subpopulations can be quantified.

For the 109P1D4 gene, RNAi studies facilitate the understanding of the contribution of the gene product in cancer pathways. Such active RNAi molecules have use in identifying assays to screen for mAbs that are active anti-tumor therapeutics. Further, siRNA are administered as therapeutics to cancer patients for reducing the malignant growth of several cancer types, including those listed in Table I. When 109P1D4 plays a role in cell survival, cell proliferation, tumorigenesis, or apoptosis, it is used as a target for diagnostic, prognostic, preventative and/or therapeutic purposes.

Throughout this application, various website data content, publications, patent applications and patents are referenced. (Websites are referenced by their Uniform Resource Locator, or URL, addresses on the World Wide Web.) The disclosures of each of these references are hereby incorporated by reference herein in their entireties.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

TABLE I

Tissues that Express 109P1D4 when malignant:

Prostate
Bladder
Kidney
Colon
Lymphoma
Lung
Pancreas
Ovary
Breast
Uterus
Stomach
Rectum
Cervix
Lymph Node
Bone

TABLE II

Amino Acid Abbreviations

| SINGLE LETTER | THREE LETTER | FULL NAME |
|---|---|---|
| F | Phe | phenylalanine |
| L | Leu | leucine |
| S | Ser | serine |
| Y | Tyr | tyrosine |
| C | Cys | cysteine |
| W | Trp | tryptophan |
| P | Pro | proline |
| H | His | histidine |
| Q | Gln | glutamine |
| R | Arg | arginine |
| I | Ile | isoleucine |
| M | Met | methionine |
| T | Thr | threonine |
| N | Asn | asparagine |
| K | Lys | lysine |
| V | Val | valine |
| A | Ala | alanine |
| D | Asp | aspartic acid |
| E | Glu | glutamic acid |
| G | Gly | glycine |

TABLE III

Amino Acid Substitution Matrix
Adapted from the GCG Software 9.0 BLOSUM62 amino acid substitution matrix (block subsbtution matrix). The higher the value, the more likely a substitution is found in related, natural proteins.
(See world wide web URL ikp.unibe.ch/manual/blosum62.html)

| A | C | D | E | F | G | H | I | K | L | M | N | P | Q | R | S | T | V | W | Y | . |
|---|---|---|---|---|---|---|---|---|---|---|---|---|---|---|---|---|---|---|---|---|
| 4 | 0 | −2 | −1 | −2 | 0 | −2 | −1 | −1 | −1 | −1 | −2 | −1 | −1 | −1 | 1 | 0 | 0 | −3 | −2 | A |
|   | 9 | −3 | −4 | −2 | −3 | −3 | −1 | −3 | −1 | −1 | −3 | −3 | −3 | −3 | −1 | −1 | −1 | −2 | −2 | C |
|   |   | 6 | 2 | −3 | −1 | −1 | −3 | −1 | −4 | −3 | 1 | −1 | 0 | −2 | 0 | −1 | −3 | −4 | −3 | D |
|   |   |   | 5 | −3 | −2 | 0 | −3 | 1 | −3 | −2 | 0 | −1 | 2 | 0 | 0 | −1 | −2 | −3 | −2 | E |
|   |   |   |   | 6 | −3 | −1 | 0 | −3 | 0 | 0 | −3 | −4 | −3 | −3 | −2 | −2 | −1 | 1 | 3 | F |
|   |   |   |   |   | 6 | −2 | −4 | −2 | −4 | −3 | 0 | −2 | −2 | −2 | 0 | −2 | −3 | −2 | −3 | G |
|   |   |   |   |   |   | 8 | −3 | −1 | −3 | −2 | 1 | −2 | 0 | 0 | −1 | −2 | −3 | −2 | 2 | H |
|   |   |   |   |   |   |   | 4 | −3 | 2 | 1 | −3 | −3 | −3 | −3 | −2 | −1 | 3 | −3 | −1 | I |
|   |   |   |   |   |   |   |   | 5 | −2 | −1 | 0 | −1 | 1 | 2 | 0 | −1 | −2 | −3 | −2 | K |
|   |   |   |   |   |   |   |   |   | 4 | 2 | −3 | −3 | −2 | −2 | −2 | −1 | 1 | −2 | −1 | L |
|   |   |   |   |   |   |   |   |   |   | 5 | −2 | −2 | 0 | −1 | −1 | −1 | 1 | −1 | −1 | M |
|   |   |   |   |   |   |   |   |   |   |   | 6 | −2 | 0 | 0 | 1 | 0 | −3 | −4 | −2 | N |
|   |   |   |   |   |   |   |   |   |   |   |   | 7 | −1 | −2 | −1 | −1 | −2 | −4 | −3 | P |
|   |   |   |   |   |   |   |   |   |   |   |   |   | 5 | 1 | 0 | −1 | −2 | −2 | −1 | Q |
|   |   |   |   |   |   |   |   |   |   |   |   |   |   | 5 | −1 | −1 | −3 | −3 | −2 | R |
|   |   |   |   |   |   |   |   |   |   |   |   |   |   |   | 4 | 1 | −2 | −3 | −2 | S |
|   |   |   |   |   |   |   |   |   |   |   |   |   |   |   |   | 5 | 0 | −2 | −2 | T |
|   |   |   |   |   |   |   |   |   |   |   |   |   |   |   |   |   | 4 | −3 | −1 | V |
|   |   |   |   |   |   |   |   |   |   |   |   |   |   |   |   |   |   | 11 | 2 | W |
|   |   |   |   |   |   |   |   |   |   |   |   |   |   |   |   |   |   |   | 7 | Y |

TABLE IV (A)

HLA Class I Supermotifs/Motifs

|  | POSITION 2 (Primary Anchor) | POSITION 3 (Primary Anchor) | POSITION C Terminus (Primary Anchor) |
|---|---|---|---|
| SUPERMOTIF | | | |
| A1 | T*ILVMS* | | FWY |
| A2 | LIVM*ATQ* | | IVM*ATL* |
| A3 | VSM*ATLI* | | RK |
| A24 | YF*WIVLMT* | | FI*YWLM* |
| B7 | P | | VILF*MWYA* |
| B27 | RHK | | FYL*WMIVA* |
| B44 | ED | | FWYLIMVA |
| B58 | ATS | | FWY*LIVMA* |
| B62 | QL*IVMP* | | FWY*MIVLA* |
| MOTIFS | | | |
| A1 | TSM | | Y |
| A1 | | DE*AS* | Y |
| A2.1 | LM*VQIAT* | | VL*IMAT* |
| A3 | LMVISATF*CGD* | | KYR*HFA* |
| A11 | VTMLISAGN*CDF* | | KRYH |
| A24 | YF*WM* | | FLIW |
| A*3101 | MVT*ALIS* | | R*K* |
| A*3301 | MVALF*IST* | | RK |

TABLE IV (A)-continued

HLA Class I Supermotifs/Motifs

|  | POSITION 2 (Primary Anchor) | POSITION 3 (Primary Anchor) | POSITION C Terminus (Primary Anchor) |
|---|---|---|---|
| A*6801 | AVT*MSLI* | | RK |
| B*0702 | P | | LMF*WYAIV* |
| B*3501 | P | | LMFWY*IVA* |
| B51 | P | | LIVF*WYAM* |
| B*5301 | P | | IMFWY*ALV* |
| B*5401 | P | | ATIV*LMFWY* |

Bolded residues are preferred, italicized residues are less preferred: A peptide is considered motif-bearing if it has primary anchors at each primary anchor position for a motif or supermotif as specified in the above table.

TABLE IV (B)

HLA Class II Supermotif

| 1 | 6 | 9 |
|---|---|---|
| W, F, Y, V, I, L | A, V, I, L, P, C, S, T | A, V, I, L, C, S, T, M, Y |

TABLE IV (C)

HLA Class II Motifs

| MOTIFS | | 1° anchor 1 | 2 | 3 | 4 | 5 | 1° anchor 6 | 7 | 8 | 9 |
|---|---|---|---|---|---|---|---|---|---|---|
| DR4 | preferred | FMY*LIVW* | M | T | | I | VST*CPALIM* | MH | | MH |
|  | deleterious | | | | W | | | | R | WDE |

TABLE IV (C)-continued

HLA Class II Motifs

| | | | | | | | | | |
|---|---|---|---|---|---|---|---|---|---|
| DR1 | preferred | MF*LIVWY* | | PAMQ | | VMAT*SPLIC* | M | | AVM |
| | deleterious | | C | CH FD | CWD | | GDE | D | |
| DR7 | preferred | MF*LIVWY* | M | W A | | IVMSA*CTPL* | M | | IV |
| | deleterious | | C | G | | | GRD | N | G |

| | | | | | | |
|---|---|---|---|---|---|---|
| DR3 | | MOTIFS | 1° anchor 1   2   3 | 1° anchor 4   5 | 1° anchor 6 | |
| Motif a preferred | | | LIVMFY | D | | |
| Motif b preferred | | | LIVMFAY | DNQEST | KRH | |
| DR Supermotif | | | MF*LIVWY* | | VMSTA*CPLI* | |

Italicized residues indicate less preferred or "tolerated" residues

TABLE IV (D)

HLA Class I Supermotifs

| SUPER-MOTIFS | | 1 | 2 | 3 | 4 | 5 | 6 | 7 | 8 | C-terminus |
|---|---|---|---|---|---|---|---|---|---|---|
| A1 | | | 1° Anchor TI*LVMS* | | | | | | | 1° Anchor FWY |
| A2 | | | 1° Anchor LIVM*ATQ* | | | | | | | 1° Anchor LIVMAT |
| A3 | Preferred | | 1° Anchor VSMA*TLI* | YFW (4/5) | | | YFW (3/5) | YFW (4/5) | P (4/5) | 1° Anchor RK |
| | deletedous | DE (3/5); P (5/5) | | DE (4/5) | | | | | | |
| A24 | | | 1° Anchor YFW*IVLMT* | | | | | | | 1° Anchor FIY*WLM* |
| B7 | Preferred | FWY (5/5) LIVM (3/5) | 1° Anchor P | FWY (4/5) | | | | | FWY (3/5) | 1° Anchor VILF*MWYA* |
| | deleterious | DE (3/5); P(5/5); G(4/5); A(3/5); QN(3/5) | | | | DE (3/5) | G (4/5) | QN (4/5) | DE (4/5) | |
| B27 | | | 1° Anchor RHK | | | | | | | 1° Anchor FYL*WMIVA* |
| B44 | | | 1° Anchor E*D* | | | | | | | 1° Anchor FWYLIMVA |
| B58 | | | 1° Anchor ATS | | | | | | | 1° Anchor FWY*LIVMA* |
| B62 | | | 1° Anchor Q*LIVMP* | | | | | | | 1° Anchor FWY*MIVLA* |

Italicized residues indicate less preferred or "tolerated" residues

TABLE IV (E)

HLA Class I Motifs

| | | | | | POSITION | | | | | |
|---|---|---|---|---|---|---|---|---|---|---|
| | | 1 | 2 | 3 | 4 | 5 | 6 | 7 | 8 | 9 or C-terminus | C-terminus |
| A1 9-mer | preferred | GFYW | 1° Anchor *STM* | DEA | YFW | | P | DEQN | YFW | 1° Anchor *Y* | |
| | deleterious | DE | | RHKLIVMP | A | G | A | | | | |
| A1 9-mer | preferred | GRHK | ASTCLIVM | 1° Anchor *DEAS* | GSTC | | ASTC | LIVM | DE | 1° Anchor *Y* | |
| | deleterious | A | RHKDEPYFW | | | | | | | | |
| A1 10-mer | preferred | YFW | 1° Anchor *STM* | DEAQN | A | YFWQN | RHK | PASTC | GDE | P | |
| | deleterious | GP | | RHKGLIVM | DE | RHK | QNA | PG | RHK | A | |
| A1 10-mer | preferred | YFW | STCLIVM | 1° Anchor *DEAS* | A | YFW | | RHKYFW | G | YFW | 1° Anchor *Y* |
| | deleterious | RHK | RHKDEPYFW | | STC | YFW | | PG | | | |
| A2.1 9-mer | preferred | YFW | 1° Anchor *LMIVQAT* | YFW | STC | YFW | G | A | P | 1° Anchor *VLIMAT* | |
| | deleterious | DEP | | DERKH | | | RKH | DERKH | PRHK | QN | |

| | | 1 | 2 | 3 | 4 | 5 | 6 | 7 | 8 | 9 | C-terminus |
|---|---|---|---|---|---|---|---|---|---|---|---|
| A2.1 10-mer | preferred | AYFW | 1° Anchor *LMIVQAT* | LVIM | G | P | G | RKH | FYWL VIM | | 1° Anchor *VLIMAT* |
| | deleterious | DEP | | DE | RKHA | | | | DERKLHRKH | | |
| A3 | preferred | RHK | 1° Anchor *LMVISATFCGD* | YFW | PRHKYF W | A | YFW | | P | 1° Anchor *KYRHFA* | |
| | deleterious | DEP | | DE | | | | | | | |

TABLE IV (E)-continued

HLA Class I Motifs

| | | 1 | 2 | 3 | 4 | 5 | 6 | 7 | 8 | |
|---|---|---|---|---|---|---|---|---|---|---|
| A11 | preferred | A | 1° Anchor VTLMISAGN*CDF* | YFW | YFW | A | YFW | YFW | P | 1° Anchor K*RYH* |
| | deleterious | DEP | | | | | | | G | |
| A24 9-mer | preferred | YFWRHK | 1° Anchor YFW*M* | | STC | | | YFW | YFW | 1° Anchor FLIW |
| | deleterious | DEG | | DE | G | QNP | DERHKG | G | AQN | |
| A24 10-mer | Preferred | | 1° Anchor YFW*M* | | P | YFWP | | P | | 1° Anchor FLIW |
| | Deleterious | | | GDE | QN | RHK | DE | A | QN | DEA |
| A3101 | Preferred | RHK | 1° Anchor MV*TALIS* | YFW | P | | YFW | YFW | AP | 1° Anchor RK |
| | Deleterious | DEP | | DE | | ADE | DE | DE | DE | |
| A3301 | Preferred | | 1° Anchor MVALF*IST* | YFW | | YFWLIVM | | AYFW | | 1° Anchor RK |
| | Deleterious | GP | | DE | | | | | | |
| A6801 | Preferred | YFWSTC | 1° Anchor AVTM*SLI* | | | RHK | | YFW | P | 1° Anchor RK |
| | Deleterious | GP | | DEG | | RHK | | | A | |
| B0702 | preferred | RHKFWY | 1° Anchor P | RHK | | RHK | RHK | RHK | PA | 1° Anchor L*MFWYAIV* |
| | deleterious | DEQNP | | DEP | DE | DE | GDE | QN | DE | |
| B3501 | Preferred | FWYLIVM | 1° Anchor P | FWY | | | | FWY | | 1° Anchor L*MFWYIVA* |

POSITION

| | | 1 | 2 | 3 | 4 | 5 | 6 | 7 | 8 | 9 or C-terminus | C-terminus |
|---|---|---|---|---|---|---|---|---|---|---|---|
| A1 9-mer | preferred | GFYW | 1° Anchor STM | DEA | YFW | | P | DEQN | YFW | 1° Anchor Y | |
| | deleterious | DE | | RHKLIVMP | A | G | A | | | | |

TABLE IV (E)-continued

HLA Class I Motifs

| | | | | | | | | | | |
|---|---|---|---|---|---|---|---|---|---|---|
| A1 9-mer | preferred | GRHK | ASTCLIVM | 1° Anchor DEAS | GSTC | ASTC | LIVM | DE | | 1° Anchor Y |
| | deleterious | | RHKDEPYFW | | | DE | PQN | RHK | | DE |
| | deleterious | | AGP | | | G | G | | | GP |
| B51 | Preferred | LIVMFWY | 1° Anchor P | FWY | STC | FWY | | G | FWY | 1° Anchor LIVFWYAM |
| | deleterious | AGPDERHKSTC | | | | | DE | DEQN | GDE | |
| B5301 | preferred | LIVMFWY | 1° Anchor P | FWY | STC | FWY | LIVMFWY | | FWY | 1° Anchor IMFWYALV |
| | deleterious | AGPQN | | | | | | G | RHKQN | DE |
| B5401 | preferred | FWY | 1° Anchor P | FWYLIVM | | LIVM | ALIVM | | FWYA P | 1° Anchor ATIVLMFWY |
| | deleterious | GPQNDE | | GDESTC | | RHKDE | DE | QNDGE | | DE |

TABLE IV (F)

Summary of HLA-supertypes
Overall phenotypic frequencies of HLA-supertypes in different ethnic populations

| | Specificity | | Phenotypic frequency | | | | | |
|---|---|---|---|---|---|---|---|---|
| Supertype | Position 2 | C-Terminus | Caucasian | N.A. Black | Japanese | Chinese | Hispanic | Average |
| B7 | P | AILMVFWY | 43.2 | 55.1 | 57.1 | 43.0 | 49.3 | 49.5 |
| A3 | AILMVST | RK | 37.5 | 42.1 | 45.8 | 52.7 | 43.1 | 44.2 |
| A2 | AILMVT | AILMVT | 45.8 | 39.0 | 42.4 | 45.9 | 43.0 | 42.2 |
| A24 | YF (WIVLMT) | FI (YWLM) | 23.9 | 38.9 | 58.6 | 40.1 | 38.3 | 40.0 |
| B44 | E (D) | FWYLIMVA | 43.0 | 21.2 | 42.9 | 39.1 | 39.0 | 37.0 |
| A1 | TI (LVMS) | FWY | 47.1 | 16.1 | 21.8 | 14.7 | 26.3 | 25.2 |
| B27 | RHK | FYL (WMI) | 28.4 | 26.1 | 13.3 | 13.9 | 35.3 | 23.4 |
| B62 | QL (IVMP) | FWY (MIV) | 12.6 | 4.8 | 36.5 | 25.4 | 11.1 | 18.1 |
| B58 | ATS | FWY (LIV) | 10.0 | 25.1 | 1.6 | 9.0 | 5.9 | 10.3 |

TABLE IV (G)

Calculated population coverage afforded by different HLA-supertype combinations

| | Phenotypic frequency | | | | | |
|---|---|---|---|---|---|---|
| HLA-supertypes | Caucasian | N.A Blacks | Japanese | Chinese | Hispanic | Average |
| A2, A3 and B7 | 83.0 | 86.1 | 87.5 | 88.4 | 86.3 | 86.2 |
| A2, A3, B7, A24, B44 and A1 | 99.5 | 98.1 | 100.0 | 99.5 | 99.4 | 99.3 |
| A2, A3, B7, A24, B44, A1, B27, B62, and B 58 | 99.9 | 99.6 | 100.0 | 99.8 | 99.9 | 99.8 |

Motifs indicate the residues defining supertype specificites. The motifs incorporate residues determined on the basis of published data to be recognized by multiple alleles within the supertype. Residues within brackets are additional residues also predicted to be tolerated by multiple alleles within the supertype.

TABLE V

Frequently Occurring Motifs

| Name | avrg. % identity | Description | Potential Function |
|---|---|---|---|
| zf-C2H2 | 34% | Zinc finger, C2H2 type | Nucleic acid-binding protein functions as transcription factor, nuclear location probable |
| cytochrome_b_N | 68% | Cytochrome b(N-terminal)/b6/petB | membrane bound oxidase, generate superoxide |
| Ig | 19% | Immunoglobulin domain | domains are one hundred amino acids long and include a conserved intradomain disulfide bond. |
| WD40 | 18% | WD domain, G-beta repeat | tandem repeats of about 40 residues, each containing a Trp-Asp motif. Function in signal transduction and protein interaction |
| PDZ | 23% | PDZ domain | may function in targeting signaling molecules to sub-membranous sites |
| LRR | 28% | Leucine Rich Repeat | short sequence motifs involved in protein-protein interactions |
| Pkinase | 23% | Protein kinase domain | conserved catalytic core common to both serine/threonine and tyrosine protein kinases containing an ATP |

TABLE V-continued

Frequently Occurring Motifs

| Name | avrg. % identity | Description | Potential Function |
|---|---|---|---|
| PH | 16% | PH domain | binding site and a catalytic site pleckstrin homology involved in intracellular signaling or as constituents of the cytoskeleton |
| EGF | 34% | EGF-like domain | 30-40 amino-acid long found in the extracellular domain of membrane-bound proteins or in secreted proteins |
| Rvt | 49% | Reverse transcriptase (RNA-dependent DNA polymerase) | |
| Ank | 25% | Ank repeat | Cytoplasmic protein, associates integral membrane proteins to the cytoskeleton |
| Oxidored_q1 | 32% | NADH-Ubiquinone/ plastoquinone (complex I), various chains | membrane associated. Involved in proton translocation across the membrane |
| Efhand | 24% | EF hand | calcium-binding domain, consists of a 12 residue loop flanked on both sides by a 12 residue alpha-helical domain |
| Rvp | 79% | Retroviral aspartyl protease | Aspartyl or acid proteases, centered on a catalytic aspartyl residue |
| Collagen | 42% | Collagen triple helix repeat (20 copies) | extracellular structural proteins involved in formation of connective tissue. The sequence consists of the G-X-Y and the polypeptide chains forms a triple helix. |
| Fn3 | 20% | Fibronectin type III domain | Located in the extracellular ligand-binding region of receptors and is about 200 amino acid residues long with two pairs of cysteines involved in disulfide bonds |
| 7tm_1 | 19% | 7 transmembrane receptor (rhodopsin family) | seven hydrophobic transmembrane regions, with the N-terminus located extracellularly while the C-terminus is cytoplasmic. Signal through G proteins |

TABLE VI

Post-translational modifications of 109P1D4

O-glycosylation sites

231 S
238 S
240 T
266 T

TABLE VI-continued

Post-translational modifications of 109P1D4

346 T
467 T
551 T
552 S
555 T

TABLE VI-continued

Post-translational modifications of 109P1D4

| | |
|---|---|
| 595 | T |
| 652 | S |
| 654 | S |
| 660 | T |
| 790 | T |
| 795 | T |
| 798 | T |
| 804 | S |
| 808 | S |
| 923 | T |
| 927 | T |
| 954 | T |
| 979 | S |
| 982 | S |
| 983 | S |
| 985 | S |
| 986 | S |
| 990 | S |
| 999 | T |
| 1000 | T |
| 1006 | S |
| 1017 | S |
| 1020 | T |

Serine phosphorylation sites

| | |
|---|---|
| 50 | DLNLSLIPN (SEQ ID NO: 62) |
| 147 | VINISIPEN (SEQ ID NO: 63) |
| 152 | IPENSAINS (SEQ ID NO: 64) |
| 238 | ILQVSVTDT (SEQ ID NO: 65) |
| 257 | EIEVSIPEN (SEQ ID NO: 66) |
| 428 | LDYESTKEY (SEQ ID NO: 67) |
| 480 | PENNSPGIQ (SEQ ID NO: 68) |
| 489 | LTKVSAMDA (SEQ ID NO: 69) |
| 495 | MDADSGPNA (SEQ ID NO: 70) |
| 559 | TVFVSIIDQ (SEQ ID NO: 71) |
| 567 | QNDNSPVFT (SEQ ID NO: 72) |
| 608 | AVTLSILDE (SEQ ID NO: 73) |
| 630 | RPNISFDRE (SEQ ID NO: 74) |
| 638 | EKQESYTFY (SEQ ID NO: 75) |
| 652 | GGRVSRSSS (SEQ ID NO: 76) |

TABLE VI-continued

Post-translational modifications of 109P1D4

| | |
|---|---|
| 654 | RVSRSSSAK (SEQ ID NO: 77) |
| 655 | VSRSSSAKV (SEQ ID NO: 78) |
| 656 | SRSSSAKVT (SEQ ID NO: 79) |
| 714 | EVRYSIVGG (SEQ ID NO: 80) |
| 789 | LVRKSTEAP (SEQ ID NO: 81) |
| 805 | ADVSSPTSD (SEQ ID NO: 82) |
| 808 | SSPTSDYVK (SEQ ID NO: 83) |
| 852 | NKQNSEWAT (SEQ ID NO: 84) |
| 877 | KKKHSPKNL (SEQ ID NO: 85) |
| 898 | DDVDSDGNR (SEQ ID NO: 86) |
| 932 | FKPDSPDLA (SEQ ID NO: 87) |
| 941 | RHYKSASPQ (SEQ ID NO: 88) |
| 943 | YKSASPQPA (SEQ ID NO: 89) |
| 982 | ISKCSSSSS (SEQ ID NO: 90) |
| 983 | SKCSSSSSD (SEQ ID NO: 91) |
| 984 | KCSSSSSDP (SEQ ID NO: 92) |
| 985 | CSSSSSDPY (SEQ ID NO: 93) |
| 990 | SDPYSVSDC (SEQ ID NO: 94) |
| 1006 | EVPVSVHTR (SEQ ID NO: 95) |

Threonine phosphorylation sites

| | |
|---|---|
| 29 | EKNYTIREE (SEQ ID NO: 96) |
| 81 | IEEDTGEIF (SEQ ID NO: 97) |
| 192 | DVIETPEGD (SEQ ID NO: 98) |
| 252 | VFKETEIEV (SEQ ID NO: 99) |
| 310 | TGLITIKEP (SEQ ID NO: 100) |
| 320 | DREETPNHK (SEQ ID NO: 101) |
| 551 | VPPLTSNVT (SEQ ID NO: 102) |
| 790 | VRKSTEAPV (SEQ ID NO: 103) |
| 856 | SEWATPNPE (SEQ ID NO: 104) |
| 924 | NWVTTPTTF (SEQ ID NO: 105) |
| 927 | TTPTTFKPD (SEQ ID NO: 106) |
| 999 | GYPVTTFEV (SEQ ID NO: 107) |
| 1000 | YPVTTFEVP (SEQ ID NO: 108) |

Tyrosine phosphorylation sites

| | |
|---|---|
| 67 | FKLVYKTGD (SEQ ID NO: 109) |
| 158 | INSKYTLPA (SEQ ID NO: 110) |
| 215 | EKDTYVMKV (SEQ ID NO: 111) |
| 359 | IDIRYIVNP (SEQ ID NO: 112) |
| 423 | ETAAYLDYE (SEQ ID NO: 113) |

TABLE VI-continued

Post-translational modifications of 109P1D4

| | |
|---|---|
| 426 | AYLDYESTK (SEQ ID NO: 114) |
| 432 | STKEYAIKL (SEQ ID NO: 115) |
| 536 | KEDKYLFTI (SEQ ID NO: 116) |
| 599 | TDPDYGDNS (SEQ ID NO: 117) |
| 642 | SYTFYVKAE (SEQ ID NO: 118) |
| 682 | SNCSYELVL (SEQ ID NO: 119) |
| 713 | AEVRYSIVG (SEQ ID NO: 120) |
| 810 | PTSDYVKIL (SEQ ID NO: 121) |
| 919 | TMGKYNWVT (SEQ ID NO: 122) |
| 989 | SSDPYSVSD (SEQ ID NO: 123) |
| 996 | SDCGYPVTT (SEQ ID NO: 124) |

TABLE VII

Search Peptides

109P1D4 v.1 - 9-mers, 10-mers and 15-mers (SEQ ID NO: 125)

```
MDLLSGTYIF AVLLACVVFH SGAQEKNYTI REEMPENVLI GDLLKDLNLS LIPNKSLTTA      60
MQFKLVYKTG DVPLIRIEED TGEIFTTGAR IDREKLCAGI PRDEHCFYEV EVAILPDEIF     120
RLVKIRFLIE DINDNAPLFP ATVINISIPE NSAINSKYTL PAAVDPDVGI NGVQNYELIK     180
SQNIFGLDVI ETPEGDKMPQ LIVQKELDRE EKDTYVMKVK VEDGGFPQRS STAILQVSVT     240
DTNDNHPVFK ETEIEVSIPE NAPVGTSVTQ LHATDADIGE NAKIHFSFSN LVSNIARRLF     300
HLNATTGLIT IKEPLDREET PNHKLLVLAS DGGLMPARAM VLVNVTDVND NVPSIDIRYI     360
VNPVNDTVVL SEMIPLNTKI ALITVTDKDA DHNGRVTCFT DHEIPFRLRP VFSNQFLLET     420
AAYLDYESTK EYAIKLLAAD AGKPPLNQSA MLFIKVKDEN DNAPVFTQSF VTVSIPENNS     480
PGIQLTKVSA MDADSGPNAK INYLLGPDAP PEFSLDCRTG MLTVVKKLDR EKEDKYLFTI     540
LAKDNGVPPL TSNVTVFVSI IDQNDNSPVF THNEYNFYVP ENLPRHGTVG LITVTDPDYG     600
DNSAVTLSIL DENDDFTIDS QTGVIRPNIS FDREKQESYT FYVKAEDGGR VSRSSSAKVT     660
INVVDVNDNK PVFIVPPSNC SYELVLPSTN PGTVVFQVIA VDNDTGMNAE VRYSIVGGNT     720
RDLFAIDQET GNITLMEKCD VTDLGLHRVL VKANDLGQPD SLFSVVIVNL FVNESVTNAT     780
LINELVRKST EAPVTPNTEI ADVSSPTSDY VKILVAAVAG TITVVVVIFI TAVVRCRQAP     840
HLKAAQKNKQ NSEWATPNPE NRQMIMMKKK KKKKKHSPKN LLLNFVTIEE TKADDVDSDG     900
NRVTLDLPID LEEQTMGKYN WVTTPTTFKP DSPDLARHYK SASPQPAFQI QPETPLNSKH     960
HIIQELPLDN TFVACDSISK CSSSSSDPYS VSDCGYPVTT FEVPVSVHTR PVGIQVSNTT    1020
F                                                                   1021

109P1D4 v.2 (both ends duff from v.1)
N'terminal
9-mers aa -30 to 8
MRTERQWVLIQIFQVLCGLIQQTVTSVPGMDLLSGTY (SEQ ID NO: 126)
10-mers aa -30 to 9
MRTERQWVLIQIFQVLCGLIQQTVTSVPGMDLLSGTYI (SEQ ID NO: 127)
15-mers aa -30 to 14
MRTERQWVLIQIFQVLCGLIQQTVTSVPGMDLLSGTYIFAVLL (SEQ ID NO: 128)

109P1D4 v.2
C' Terminal
9 mers: aa 1004 to 1025
PVSVHTRPTDSRTSTIEICSEI (SEQ ID NO: 129)
10 mers: aa 1003 to 1025
VPVSVHTRPTDSRTSTIEICSEI (SEQ ID NO: 130)
15 mers: aa 997 to 1025
VTTFEVPVSVHTRPTDSRTSTIEICSEI (SEQ ID NO: 131)

109P1D4 v.3
9 mers: aa 1004 to 1347 (SEQ ID NO: 132)
PVSVHTRPPMKEVVRSCTPMKESTTMEIWIHPQPQRKSEGKVAGKSQRRVTFHLPEGSQESSSDG
GLGDHDAGSLTSTSHGLPLGYPQEEYFDRATPSNRTEGDGNSDPESTFIPGLKKAAEITVQPTVE
```

TABLE VII-continued

Search Peptides

EASDNCTQECLIYGHSDACWMPASLDHSSSSQAQASALCHSPPLSQASTQHHSPRVTQTIALCHS

PPVTQTIALCHSPPPIQVSKLHHSPPLVQATALHHSPPSAQASALCYSPPLAQAAAISHSSPLPQ

VIALHRSQAQSSVSLQQGWVQGADGLCSVDQGVQGSATSQFYTMSERLHPSDDSIKVIPLTTFTP

RQQARPSRGDSPMEEHPL 10 mers: aa 1003 to 1347 (SEQ ID NO: 133)
VPVSVHTRPPMKEVVRSCTPMKESTTMEIWIHPQPQRKSEGKVAGKSQRRVTFHLPEGSQESSSD

GGLGDHDAGSLTSTSHGLPLGYPQEEYFDRATPSNRTEGDGNSDPESTFIPGLKKAAEITVQPTV

EEASDNCTQECLIYGHSDACWMPASLDHSSSSQAQASALCHSPPLSQASTQHHSPRVTQTIALCH

SPPVTQTIALCHSPPPIQVSALHHSPPLVQATALHHSPPSAQASALCYSPPLAQAAAISHSSPLP

QVIALHRSQAQSSVSLQQGWVQGADGLCSVDQGVQGSATSQFYTMSERLHPSDDSIKVIPLTTFT

PRQQARPSRGDSPMEEHPL 15 mers: aa 998 to 1347 (SEQ ID NO: 134)
VTTFEVPVSV HTRPPMKEVV RSCTPMKEST TMEIWIHPQP QRKSEGKVAG KSQRRVTFHL

PEGSQESSSD GGLGDHDAGS LTSTSHGLPL GYPQEEYFDR ATPSNRTEGD GNSDPESTFI

PGLKKAAEIT VQPTVEEASD NCTQECLIYG HSDACWMPAS LDHSSSSQAQ ASALCHSPPL

SQASTQHHSP RVTQTIALCH SPPVTQTIAL CHSPPPIQVS ALHHSPPLVQ ATALHHSPPS

AQASALCYSP PLAQAAAISH SSPLPQVIAL HRSQAQSSVS LQQGWVQGAD GLCSVDQGVQ

GSATSQFYTM SERLHPSDDS IKVIPLTTFT PRQQARPSRG DSPMEEHPL

109P1D4 v.4 (deleting 10 aa, 1039-1048, from v.1)
9-mers aa 1031-1056 (deleting 10 aa, 1039-1048, from v.1)
IWIHPQPQSQRRVTFH (SEQ ID NO: 135)
10-mers aa 1030-1057 (deleting 10 aa, 1039-1048, from v.1)
EIWIHPQPQSQRRVTFHL (SEQ ID NO: 136)
15-mers aa 1025-1062 (deleting 10 aa, 1039-1048, from v.1)
ESTTMEIWIHPQPQSQRRVTFHLPEGSQ (SEQ ID NO: 137)

109P1D4 v.5 (deleting 37 aa, 1012-1048, from v.1)
9-mers aa 1004-1056 (deleting 37 aa, 1012-1048, from v.1)
PVSVHTRPSQRRVTFH (SEQ ID NO: 138)
10-mers aa 1003-1057 (deleting 37 aa, 1012-1048, from v.1)
VPVSVHTRPSQRRVTFHL (SEQ ID NO: 139)
15-mers aa 998-1062 (deleting 37 aa, 1012-1048, from v.1)
VTTFEVPVSVHTRPSQRRVTFHLPEGSQ (SEQ ID NO: 140)

109P1D4 v.6 (both ends diff from v.1)
N'terminal
9-mers: aa -23 to 10 (excluding 1 and 2)
MTVGFNSDISSVVRVNTTNCHKCLLSGTYIF (SEQ ID NO: 141)
10-mers: aa -23 to 11 (excluding 1 and 2)
MTVGFNSDISSVVRVNTTNCHKCLLSGTYIFA (SEQ ID NO: 142)
15-mers: aa -23 to 17 (excluding 1 and 2)
MTVGFNSDISSVVRVNTTNCHKCLLSGTYIFAVLLVC (SEQ ID NO: 143)

109P1D4 v.6
C' terminal
9-mers: aa 1004-1016
PVSVHTRPTDSRT (SEQ ID NO: 144)
10-mers: aa 1003-1016
VPVSVHTRPTDSRT (SEQ ID NO: 145)
15-mers: aa 998-1016
VTTFEVPVSVHTRPTDSRT (SEQ ID NO: 146)

109P1D4 v.7 (N-terminal 21 aa diff from those in v.6)
N' terminal
9-mers aa -21 to 10 (excluding 1 and 2)
MFRVGFLIISSSSSLSPLLLVSVVRVNTT (SEQ ID NO: 147)
10-mers aa -21 to 11 (excluding 1 and 2)
MFRVGFLIISSSSSLSPLLLVSVVRVNTTN (SEQ ID NO: 148)
15-mers aa -21 to 16 (excluding 1 and 2)
MFRVGFLIISSSSSLSPLLLVSVVRVNTTNCHKCL (SEQ ID NO: 149)

TABLE VII-continued

Search Peptides

```
109P1D4 v.8
9-mers aa 1099-1126 (excluding 1117 and 1118)
TFIPGLKKEITVQPTV (SEQ ID NO: 150)
10-mers aa 1098-1127 (excluding 1117 and 1118)
TFIPGLKKEITVQPTVE (SEQ ID NO: 151)
15-mers aa 1093-1131 (excluding 1117 and 1118)
NSDPESTFIPGLKKEITVQPTVEEASDN (SEQ ID NO: 152)

109P1D4 v.1, v.2 and v.3 SNP variants
A15V
9-mers
TYIFAVLLCVVFHSGA (SEQ ID NO: 153)
10-mers
GTYIFAVLLVCVVFHSGAQ (SEQ ID NO: 154)
15-mers
MDLLSGTYIFAVLLVCVVFHSGAQEKNYT (SEQ ID NO: 155)

109P1D4 v.1, v.2 and v.3 SNP variants
M341
9-mers
KNYTIREEIPENVLIGD (SEQ ID NO: 156)
10-mers
EKNYTIREEIPENVLIGDL (SEQ ID NO: 157)
15-mers
HSGAQEKNYTIREEIPENVLIGDLLKDLN (SEQ ID NO: 158)

109P1O4 v.1, v.2 and v.3 SNP variants
M341 and D42N
9-mers
KNYTIREEIPENVLIGN (SEQ ID NO: 159)
10-mers
EKNYTIREEIPENVLIGNL (SEQ ID NO: 160)
15-mers
HSGAQEKNTYTIREEIPENVLIGNLLKDLN (SEQ ID NO: 161)

109P1D4 v.1, v.2 and v.3 SNP variants
D42N
9-mers
MPENVLIGNLLKDLNLS (SEQ ID NO: 162)
10-mers
MPENVLIGNLLKDLNLSL (SEQ ID NO: 163)
15-mers
YTIREEMPENVLIGNLLKDLNLSLIPNKS (SEQ ID NO: 164)

109P1D4 v.1, v.2 and v.3 SNP variants
D42N and M341
9-mers
IPENVLIGNLLKDLNLS (SEQ ID NO: 165)
10-mers
EIPENVLIGNLLKDLNLSL (SEQ ID NO: 166)
15-mers
YTIREEIPENVLIGNLLKDLNLSLIPNKS (SEQ ID NO: 167)

109P1D4 v.1, v.2 and v.3 SNP variants
A60T
9-mers
IPNKSLTTTMQFKLVYK (SEQ ID NO: 168)
10-mers
LIPNKSLTTTMQFKLVYKT (SEQ ID NO: 169)
15-mers
DLNLSLIPNKSLTTTMQFKLVYKTGDVPLI (SEQ ID NO: 170)

109P1O4 v.1, v.2 and v.3 SNP variants
I154V
9-mers
ISIPENSAVNSKYTLPA (SEQ ID NO: 171)
10-mers
NISIPENSAVNSKYTLPAA (SEQ ID NO: 172)
15-mers
PATVINISIPENSAVNSKYTLPAAVDPDV (SEQ ID NO: 173)

109P1D4 v.1, v.2 and v.3 SNP variants
V292I
9-mers
IHFSFSNLISNIARRLF (SEQ ID NO: 174)
10-mers
KIHFSFSNLISNIARRLFH (SEQ ID NO: 175)
15-mers
```

TABLE VII-continued

Search Peptides

IGENAKIHFSFSNLISNIARRLFHLNATT (SEQ ID NO: 176)

109P1D4 v.1, v.2 and v.3 SNP variants
T420N
9-mers
FSNQFLLENAAYLDYES (SEQ ID NO: 177)
10-mers
VFSNQFLLENAAYLDYEST (SEQ ID NO: 178)
15-mers
FRLRPVFSNQFLLENAAYLDYESTKEYAI (SEQ ID NO: 179)

109P1D4 v.1, v.2 and v.3 SNP variants
T486M
9-mers
NNSPGIQLMKVSAMDAD (SEQ ID NO: 180)
10-mers
ENNSPGIQLMKVSAMDADS (SEQ ID NO: 181)
15-mers
TVSIPENNSPGIQLMKVTSAMDADSGPNAK (SEQ ID NO: 182)

109P1D4 v.1, v.2 and v.3 SNP variants
T486M and M491T
9-mers
NNSPGIQLMKVSATDAD (SEQ ID NO: 183)
10-mers
ENNSPGIQLMKVSATDADS (SEQ ID NO: 184)
15-mers
TVSIPENNSPGIQLMKVSATDADSGPNAK (SEQ ID NO: 185)

109P104 v.1, v.2 and v.3 SNP variants
T486M and M491T and K500E
15-mers
TVSIPENNSPGIQLMKVSATDADSGPNAE (SEQ ID NO: 186)

109P1D4 v.1, v.2 and v.3 SNP variants
T486M and K500E
15-mers
TVSIPENNSPGIQLMKVSAMDADSGPNAE (SEQ ID NO: 187)

109P1D4 v.1, v.2 and v.3 SNP variants
M491T
9-mers
IQLTKVSATDADSGPNA (SEQ ID NO: 188)
10-mers
GIQLTKVSATDADSGPNAK (SEQ ID NO: 189)
15-mers
ENNSPGIQLTKVSATDADSGPNAKINYLL (SEQ ID NO: 190)

109P1D4 v.1, v.2 and v.3 SNP variants
M491T and T486M
9-mers
IQLNKVSATDADSGPNA (SEQ ID NO: 191)
10-mers
GIQLNKVSATDADSGPNAK (SEQ ID NO: 192)
15-mers
ENNSPGIQLNKVSATDADSGPNAKINYLL (SEQ ID NO: 193)

109P1D4 v.1, v.2 and v.3 SNP variants
M491T and T486M and K500E
10-mers
GIQLNKVSATDADSGPNAE (SEQ ID NO: 194)
15-mers
ENNSPGIQLNKVSATDADSGPNAEINYLL (SEQ ID NO: 195)

109P1D4 v.1, v.2 and v.3 SNP variants
M491T and K500E
15-mers
ENNSPGIQLTKVSATDADSGPNAEINYLL (SEQ ID NO: 196)

109P1D4 v.1, v.2 and v.3 SNP variants
K500E
9-mers
DADSGPNAEINYLLGPD (SEQ ID NO: 197)
10-mers
MDADSGPNAEINYLLGPDA (SEQ ID NO: 198)
15-mers
TKVSAMDADSGPNAEINYLLGPDAPPEFS (SEQ ID NO: 199)

TABLE VII-continued

Search Peptides

109P1D4 v.1, v.2 and v.3 SNP variants
K500E and M491T
10-mers
TDADSGPNAEINYLLGPDA (SEQ ID NO: 200)
15-mers
TKVSATDADSGPNAEINYLLGPDAPPEFS (SEQ ID NO: 201)

109P1D4 v.1, v.2 and v.3 SNP variants
K500E and M491T and T486M
15-mers
MKVSATDADSGPNAEINYLLGPDAPPEFS (SEQ ID NO: 202)

109P1D4 v.1, v.2 and v.3 SNP variants
K500E and T486M
15-mers
MKVSANDADSGPNAEINYLLGPDAPPEFS (SEQ ID NO: 203)

109P1D4 v.1, v.2 and v.3 SNP variants
C517R
9-mers
APPEFSLDRRTGMLTVV (SEQ ID NO: 204)
10-mers
DAPPEFSLDRRTGMLTVVK (SEQ ID NO: 205)
15-mers
INYLLGPDAPPEFSLDRRTGMLTVVKKLDRE (SEQ ID NO: 206)

109P1D4 v.1, v.2 and v.3 SNP variants
N576K
9-mers
PVFTHNEYKFYVPENLP (SEQ ID NO: 207)
10-mers
SPVFTHNEYKFYVPENLPR (SEQ ID NO: 208)
15-mers
DQNDNSPVFTHNEYKFYVPENLPRHGTVG (SEQ ID NO: 209)

109P1D4 v.1, v.2 and v.3 SNP variants
S678Y
9-mers
KPVFIVPPYNCSYELVLPS (SEQ ID NO: 210)
10-mers
NKPVFIVPPYNCSYELVLPST (SEQ ID NO: 211)
15-mers
VDVNDNKPVFIVPPYNCSYELVLPSTNPG (SEQ ID NO: 212)

109P1D4 v.1, v.2 and v.3 SNP variants
S678Y and C680Y
9-mers
KPVFIVPPYNYSYELVLPS (SEQ ID NO: 213)
10-mers
NKPVFIVPPYNYSYELVLPST (SEQ ID NO: 214)
15-mers
VDVNDNKPVFIVPPYNYSYELVLPSTNPG (SEQ ID NO: 215)

109P1D4 v.1, v.2 and v.3 SNP variants
C680Y
9-mers
VFIVPPSNYSYELVLPS (SEQ ID NO: 216)
10-mers
PVFIVPPSNYSYELVLPST (SEQ ID NO: 217)
15-mers
VNDNKPVFIVPPSNYSYELVLPSTNPGTV (SEQ ID NO: 218)

109P1D4 v.1, v.2 and v.3 SNP variants
C680Y and S678Y
9-mers
VFIVPPYNYSYELVLPS (SEQ ID NO: 219)
10-mers
PVFIVPPYNYSYELVLPST (SEQ ID NO: 220)
15-mers
VNDNKPVFIVPPYNYSYELVLPSTNPGTV (SEQ ID NO: 221)

109P1D4 v.1, v.2 and v.3 SNP variants
T790I
9-mers
INELVRKSIEAPVTPNT (SEQ ID NO: 222)
10-mers
LINELVRKSIEAPVTPNTE (SEQ ID NO: 223)
15-mers

TABLE VII-continued

Search Peptides

VTNATLINELVRKSIEAPVTPNTEIADVS (SEQ ID NO: 224)

109P1D4 v.1, v.2 and v.3 SNP variants
K846M
9-mers
HLKAAQKNMQNSEWATP (SEQ ID NO: 225)
10-mers
PHLKAAQKNMQNSEWATPN (SEQ ID NO: 226)
15-mers
RCRQAPHLKAAQKNMQNSEWATPNPENRQ (SEQ ID NO: 227)

109P1D4 v.1, v.2 and v.3 SNP variants
F855V
9-mers
SPKNLLLNVVTIEETKA (SEQ ID NO: 228)
10-mers
HSPKNLLLNVVTIEETKAD (SEQ ID NO: 229)
15-mers
KKKKKHSPKNLLLNVVTIEETKADDVDSD (SEQ ID NO: 230)

109P1D4 v.1, v.2 and v.3 SNP variants
S958L
9-mers
IQPETPLNLKHHIIQEL (SEQ ID NO: 231)
10-mers
QIQPETPLNLKHHIIQELP (SEQ ID NO: 232)
15-mers
PQPAFQIQPETPLNLKHHIIQELPLDNTF (SEQ ID NO: 233)

109P1D4 v.1, v.2 and v.3 SNP variants
K980N
9-mers
FVACDSISNCSSSSSDP (SEQ ID NO: 234)
10-mers
TFVACDSISNCSSSSSDPY (SEQ ID NO: 235)
15-mers
LPLDNTFVACDSISNCSSSSSDPYSVSDC (SEQ ID NO: 236)

TABLE VIII

109P1D4v.1-A1-9-mers
Each peptide is a portion of SEQ ID NO: 3; each start position is specified, the length of peptide is 9 amino acids, and the end position for each peptide is the start position plus eight

| Start | Subsequence | Score |
|---|---|---|
| 910 | DLEEQTMGK | 90.000 |
| 399 | FTDHEIPFR | 25.000 |
| 189 | VIETPEGDK | 18.000 |
| 594 | VTDPDYGDN | 12.500 |
| 278 | IGENAKIHF | 11.250 |
| 275 | DADIGENAK | 10.000 |
| 492 | DADSGPNAK | 10.000 |
| 370 | LSENIPLNT | 6.750 |
| 929 | KPDSPDLAR | 6.250 |
| 688 | STNPGTVVF | 5.000 |
| 674 | IVPPSNCSY | 5.000 |
| 163 | AVDPDVGIN | 5.000 |
| 113 | AILPDEIFR | 5.000 |
| 242 | TNDNHPVFK | 5.000 |
| 220 | KVEDGGFPQ | 4.500 |
| 797 | NTEIADVSS | 4.500 |
| 951 | QPETPLNSK | 4.500 |
| 807 | TSDYVKILV | 3.750 |
| 329 | ASDGGLMPA | 3.750 |
| 59 | TAMQFKLVY | 2.500 |
| 738 | KCDVTDLGL | 2.500 |
| 354 | SIDIRYIVN | 2.500 |
| 351 | NVPSIDIRY | 2.500 |
| 932 | SPDLARHYK | 2.500 |

TABLE VIII-continued

1091D4v.1-A1-9-mers
Each peptide is a portion of SEQ ID NO: 3; each start position is specified, the length of peptide is 9 amino acids, and the end position for each peptide is the start position plus eight

| Start | Subsequence | Score |
|---|---|---|
| 911 | LEEQTMGKY | 2.500 |
| 789 | STEAPVTPN | 2.500 |
| 253 | EIEVSIPEN | 1.500 |
| 897 | DSDGNRVTL | 1.500 |
| 479 | NSPGIQLTK | 1.500 |
| 985 | SSDPYSVSD | 1.500 |
| 991 | VSDCGYPVT | 1.500 |
| 68 | KTGDVPLIR | 1.250 |
| 741 | VTDLGLHRV | 1.250 |
| 273 | ATDADIGEN | 1.250 |
| 570 | FTHNEYNFY | 1.250 |
| 522 | LTVVKKLDR | 1.250 |
| 85 | FTTGARIDR | 1.250 |
| 779 | ATLINELVR | 1.250 |
| 192 | TPEGDKMPQ | 1.125 |
| 858 | MPENRQMIM | 1.125 |
| 148 | IPENSAINS | 1.125 |
| 591 | LITVTDPDY | 1.000 |
| 37 | NVLIGDLLK | 1.000 |
| 172 | GVQNYELIK | 1.000 |
| 800 | IADVSSPTS | 1.000 |
| 438 | AADAGKPPL | 1.000 |
| 972 | FVACDSISK | 1.000 |
| 518 | RTGMLTVVK | 1.000 |
| 854 | WATPNPENR | 1.000 |
| 527 | KLDREKEDK | 1.000 |
| 644 | KAEDGGRVS | 0.900 |
| 76 | RIEEDTGEI | 0.900 |
| 204 | QKELDREEK | 0.900 |
| 708 | NAEVRYSIV | 0.900 |
| 316 | DREETPNHK | 0.900 |
| 128 | LIEDINDNA | 0.900 |
| 931 | DSPDLARHY | 0.750 |
| 20 | HSGAQEKNY | 0.750 |
| 981 | CSSSSSDPY | 0.750 |

TABLE VIII-continued

1091D4v.1-A1-9-mers
Each peptide is a portion of SEQ ID NO: 3; each start position is specified, the length of peptide is 9 amino acids, and the end position for each peptide is the start position plus eight

| Start | Subsequence | Score |
|---|---|---|
| 55 | KSLTTAMQF | 0.750 |
| 635 | KQESYTFYV | 0.675 |
| 727 | DQETGNITL | 0.675 |
| 69 | TGDVPLIRI | 0.625 |
| 612 | ENDDFTIDS | 0.625 |
| 495 | SGPNAKINY | 0.625 |
| 804 | SSPTSDYVK | 0.600 |
| 221 | VEDGGFPQR | 0.500 |
| 201 | LIVQKELDR | 0.500 |
| 609 | ILDENDDFT | 0.500 |
| 892 | DADDVDSDG | 0.500 |
| 895 | DVDSDGNRV | 0.500 |
| 700 | AVDNDTGMN | 0.500 |
| 389 | DADHNGRVT | 0.500 |
| 802 | DVSSPTSDY | 0.500 |
| 645 | AEDGGRVSR | 0.500 |
| 740 | DVTDLGLHR | 0.500 |
| 617 | TIDSQTGVI | 0.500 |
| 725 | AIDQETGNI | 0.500 |
| 304 | ATTGLITIK | 0.500 |
| 241 | DTNDNHPVF | 0.500 |
| 514 | SLDCRTGML | 0.500 |
| 974 | ACDSISKCS | 0.500 |
| 116 | PDEIFRLVK | 0.450 |
| 77 | IEEDTGEIF | 0.450 |
| 475 | IPENNSPGI | 0.450 |
| 258 | IPENAPVGT | 0.450 |
| 109 | EVEVAILPD | 0.450 |
| 401 | DHEIPFRLR | 0.450 |
| 435 | KLLAADAGK | 0.400 |
| 780 | TLINELVRK | 0.400 |
| 256 | VSIPENAPV | 0.300 |
| 940 | KSASPQPAF | 0.300 |
| 851 | NSEWATPNP | 0.270 |

TABLE VIII-continued

109P1D4v.1-A1-9-mers
Each peptide is a portion of SEQ ID NO: 3; each start position is specified, the length of peptide is 9 amino acids, and the end position for each peptide is the start position plus eight

| Start | Subsequence | Score |
|---|---|---|
| 744 | LGLHRVLVK | 0.250 |
| 704 | DTGMNAEVR | 0.250 |
| 666 | VNDNKPVFI | 0.250 |
| 387 | DKDADHNGR | 0.250 |
| 350 | DNVPSIDIR | 0.250 |
| 459 | ENDNAPVFT | 0.250 |
| 90 | RIDREKLCA | 0.250 |

TABLE IX

109P1D4v.1-A1-10-mers
Each peptide is a portion of SEQ ID NO: 3; each start position is specified, the length of peptide is 10 amino acids, and the end position for each peptide is the start position plus nine,

| Pos | Subsequence | Score |
|---|---|---|
| 189 | LLETaAYLDY | 225.000 |
| 682 | DLEEqTMGKY | 45.000 |
| 266 | DSGPnAKINY | 37.500 |
| 142 | LSENiPLNTK | 27.000 |
| 195 | YLDYeSTKEY | 25.000 |
| 416 | KAEDgGRVSR | 18.000 |
| 101 | ASDGgLMPAR | 15.000 |
| 366 | VTDPdYGDNS | 12.500 |
| 389 | TIDSqTGVIR | 10.000 |
| 757 | SSDPySVSDC | 7.500 |
| 122 | DNVPsIDIRY | 6.250 |
| 171 | FTDHeIPFRL | 6.250 |
| 575 | VSSPtSDYVK | 6.000 |
| 407 | KQESyTFYVK | 5.400 |
| 445 | FIVPpSNCSY | 5.000 |
| 561 | STEApVTPNT | 4.500 |
| 480 | NAEVrYSIVG | 4.500 |
| 579 | TSDYvKILVA | 3.750 |
| 381 | ILDEnDDFTI | 2.500 |

TABLE IX-continued

109P1D4v.1-A1-10-mers
Each peptide is a portion of SEQ ID NO: 3; each start position is specified, the length of peptide is 10 amino acids, and the end position for each peptide is the start position plus nine,

| Pos | Subsequence | Score |
|---|---|---|
| 472 | AVDNdTGMNA | 2.500 |
| 299 | KLDReKEDKY | 2.500 |
| 286 | SLDCrTGMLT | 2.500 |
| 117 | VTDVnDNVPS | 2.500 |
| 250 | NNSPgIQLTK | 2.500 |
| 501 | ETGNiTLMEK | 2.500 |
| 476 | DTGMnAEVRY | 2.500 |
| 276 | LLGPdAPPEF | 2.000 |
| 763 | VSDCgYPVTT | 1.500 |
| 735 | IQELpLDNTF | 1.350 |
| 513 | VTDLgLHRVL | 1.250 |
| 45 | ATDAdIGENA | 1.250 |
| 11 | VTDTnDNHPV | 1.250 |
| 630 | NPENrQMIMM | 1.125 |
| 23 | ETEleVSIPE | 1.125 |
| 210 | AADAgKPPLN | 1.000 |
| 264 | DADSgPNAKI | 1.000 |
| 362 | GLITvTDPDY | 1.000 |
| 515 | DLGLhRVLVK | 1.000 |
| 47 | DADIgENAKI | 1.000 |
| 290 | RTGMITVVKK | 1.000 |
| 551 | ATLInELVRK | 1.000 |
| 13 | DTNDnHPVFK | 1.000 |
| 161 | DADHnGRVTC | 1.000 |
| 659 | TIEEtKADDV | 0.900 |
| 25 | EIEV5IPENA | 0.900 |
| 229 | KDENdNAPVF | 0.900 |
| 338 | NSPVfTHNEY | 0.750 |
| 60 | FSNLvSNIAR | 0.750 |
| 278 | GPDApPEFSL | 0.625 |
| 335 | QNDNSPVFTH | 0.625 |
| 120 | VNDNvPSIDI | 0.625 |
| 231 | ENDNaPVFTQ | 0.625 |
| 438 | VNDNkPVFIV | 0.625 |

TABLE IX-continued

109P1D4v.1-
A1-10-mers
Each peptide is a portion of
SEQ ID NO: 3; each start
position is specified, the
length of peptide is 10 amino
acids, and the end position for
each peptide is the start
position plus nine.

| Pos | Subsequence | Score |
|---|---|---|
| 80 | LITIkEPLDR | 0.500 |
| 293 | MLTVvKKLDR | 0.500 |
| 105 | GLMPaRAMVL | 0.500 |
| 721 | QIQPeTPLNS | 0.500 |
| 280 | DAPPeFSLDC | 0.500 |
| 592 | GTITvVVVIF | 0.500 |
| 169 | TCFTdHEIPF | 0.500 |
| 49 | DIGEnAKIHF | 0.500 |
| 460 | STNPgTVVFQ | 0.500 |
| 435 | VVDVnDNKPV | 0.500 |
| 746 | ACDSiSKCSS | 0.500 |
| 664 | KADDvDSDGN | 0.500 |
| 396 | VIRPnISFDR | 0.500 |
| 332 | IIDQnDNSPV | 0.500 |
| 262 | AMDAdSGPNA | 0.500 |
| 510 | KCDVtDLGLH | 0.500 |
| 667 | DVDSdGNRVT | 0.500 |
| 497 | AIDQeTGNIT | 0.500 |
| 713 | SASPqPAFQI | 0.500 |
| 752 | KCSSsSSDPY | 0.500 |
| 550 | NATLiNELVR | 0.500 |
| 83 | IKEPIDREET | 0.450 |
| 544 | VNESvTNATL | 0.450 |
| 610 | QAPHIKAAQK | 0.400 |
| 703 | DSPDIARHYK | 0.300 |
| 28 | VSIPeNAPVG | 0.300 |
| 220 | QSAMIFIKVK | 0.300 |
| 665 | ADDVdSDGNR | 0.250 |
| 218 | LNQSaMLFIK | 0.250 |
| 474 | DNDTgMNAEV | 0.250 |
| 701 | KPDSpDLARH | 0.250 |
| 530 | QPDSIFSVVI | 0.250 |
| 676 | TLDLpIDLEE | 0.250 |
| 233 | DNAPVFTQSF | 0.250 |
| 704 | SPDLaRHYKS | 0.250 |
| 569 | NTEIaDVSSP | 0.225 |
| 30 | IPFNaPVGTS | 0.225 |
| 303 | EKEDkYLFTI | 0.225 |
| 247 | IPENnSPGIQ | 0.225 |
| 351 | VPENIPRHGT | 0.225 |
| 723 | QPETpLNSKH | 0.225 |
| 201 | TKEYaIKLLA | 0.225 |
| 50 | IGENaKIHES | 0.225 |
| 175 | EIPFrLRPVF | 0.200 |
| 193 | AAYLdYESTK | 0.200 |
| 598 | VVIFiTAVVR | 0.200 |
| 456 | LVLPsTNPGT | 0.200 |

TABLE X

109P1D4v.1-
A0201-9-mers
Each peptide is a portion of
SEQ ID NO: 3; each start
position is specified, the
length of peptide is 9 amino
acids, and the end position for
each peptide is the start
position plus eight.

| Pos | Sequence | Score |
|---|---|---|
| 356 | FLLETAAYL | 8198.910 |
| 54 | ILPDEIFRL | 1986.272 |
| 697 | GQPDSLFSV | 385.691 |
| 273 | GLMPARAMV | 257.342 |
| 460 | GMLTVVKKL | 131.296 |
| 765 | VVVIFITAV | 90.423 |
| 280 | MVLVNVTDV | 88.043 |
| 820 | NLLLNFVTI | 73.343 |
| 61 | RLVKIRFLI | 60.510 |
| 549 | ILDENDDFT | 55.992 |
| 575 | DQESYTFYV | 50.389 |
| 598 | KVTINVVDV | 48.991 |
| 234 | NIARRLFHL | 39.184 |

TABLE X-continued

109P1D4v.1-
A0201-9-mers
Each peptide is a portion of
SEQ ID NO: 3; each start
position is specified, the
length of peptide is 9 amino
acids, and the end position for
each peptide is the start
position plus eight.

| Pos | Sequence | Score |
| --- | --- | --- |
| 479 | TILAKDNGV | 35.385 |
| 704 | SVVIVNLFV | 33.472 |
| 4 | KLVYKTGDV | 31.646 |
| 854 | QTMGKYNWV | 29.487 |
| 174 | ILQVSVTDT | 29.137 |
| 753 | ILVAAVAGT | 29.137 |
| 905 | ELPLDNTFV | 28.690 |
| 238 | RLFHLNATT | 27.572 |
| 121 | SQNIFGLDV | 26.797 |
| 930 | SVSDCGYPV | 24.952 |
| 674 | TLMEKCDVT | 22.711 |
| 223 | HIHFSFSNL | 19.533 |
| 711 | FVNESVTNA | 18.856 |
| 556 | FTIDSQTGV | 18.219 |
| 855 | TMGKYNWVT | 16.550 |
| 939 | TTFEVPVSV | 14.564 |
| 633 | TVVFQVIAV | 13.997 |
| 625 | VLPSTNPGT | 12.668 |
| 284 | NVTDVNDNV | 12.226 |
| 308 | VVLSENIPL | 11.757 |
| 685 | GLHRVLVKA | 11.426 |
| 709 | NLFVNESVT | 11.305 |
| 1 | MQFKLVYKT | 10.931 |
| 299 | YIVNPVNDT | 10.841 |
| 274 | LMPARAMVL | 10.754 |
| 247 | GLITIKEPL | 10.468 |
| 210 | QLHATDADI | 10.433 |
| 888 | FQIQPETPL | 9.963 |
| 490 | LTSNVTVFV | 9.032 |
| 843 | VTLDLPIDL | 7.652 |
| 423 | IQLTKVSAM | 7.287 |
| 688 | RVLVKANDL | 6.916 |
| 511 | THNEYNFYV | 6.317 |
| 486 | GVPPLTSNV | 6.086 |

TABLE X-continued

109P1D4v.1-
A0201-9-mers
Each peptide is a portion of
SEQ ID NO: 3; each start
position is specified, the
length of peptide is 9 amino
acids, and the end position for
each peptide is the start
position plus eight.

| Pos | Sequence | Score |
| --- | --- | --- |
| 673 | ITLMEKCDV | 6.076 |
| 630 | NPGTVVFQV | 6.057 |
| 757 | AVAGTITVV | 5.739 |
| 683 | DLGLHRVLV | 5.216 |
| 300 | IVNPVNDTV | 5.069 |
| 766 | VVIFITAVV | 4.242 |
| 472 | KEDKYLFTI | 3.789 |
| 75 | NAPLFPATV | 3.671 |
| 763 | TVVVVIFIT | 3.566 |
| 116 | YELIKSQNI | 3.453 |
| 493 | NVTVFVSII | 3.271 |
| 67 | FLIEDINDN | 3.233 |
| 762 | ITVVVVIFI | 3.116 |
| 190 | KETEIEVSI | 2.911 |
| 403 | APVFTQSFV | 2.497 |
| 453 | FSLDCRTGM | 2.263 |
| 750 | YVKILVAAV | 2.254 |
| 743 | VSSPTSDYV | 2.080 |
| 662 | DLFAIDQET | 2.068 |
| 825 | FVTIEETKA | 2.000 |
| 906 | LPLDNTFVA | 1.989 |
| 352 | FSNQFLLET | 1.956 |
| 354 | NQFLLETAA | 1.864 |
| 859 | YNWVTTPTT | 1.857 |
| 275 | MPARAMVLV | 1.775 |
| 436 | GPNAKINYL | 1.764 |
| 266 | LVLASDGGL | 1.528 |
| 681 | VTDLGLHRV | 1.511 |
| 819 | KNLLLNFVT | 1.498 |
| 386 | LNQSAMLFI | 1.465 |
| 764 | VVVVIFITA | 1.404 |
| 708 | VNLFVNESV | 1.399 |
| 309 | VLSENIPLN | 1.195 |
| 515 | YNFYVPENL | 1.163 |

TABLE X-continued

109P1D4v.1-A0201-9-mers
Each peptide is a portion of SEQ ID NO: 3; each start position is specified, the length of peptide is 9 amino acids, and the end position for each peptide is the start position plus eight.

| Pos | Sequence | Score |
|---|---|---|
| 322 | LITVTDKDA | 1.161 |
| 777 | RQAPHLKAA | 1.159 |
| 224 | IHFSFSNLV | 1.154 |
| 454 | SLDCRTGML | 1.111 |
| 913 | VACDSISKC | 1.106 |
| 267 | VLASDGGLM | 1.098 |
| 370 | KEYAIKLLA | 1.082 |
| 407 | TQSFVTVSI | 1.058 |
| 169 | RSSTAILQV | 1.044 |
| 735 | TPNTEIADV | 1.044 |
| 420 | SPGIQLTKV | 1.044 |
| 171 | STAILQVSV | 0.966 |
| 756 | AAVAGTITV | 0.966 |
| 264 | KLLVLASDG | 0.965 |
| 366 | YESTKEYAI | 0.933 |
| 946 | SVHTRPVGI | 0.913 |
| 658 | GNTRDLFAI | 0.908 |
| 350 | PVFSNQFLL | 0.882 |
| 314 | IPLNTKIAL | 0.877 |

TABLE XI

109P1D4v.1-A0201-10-mers
Each peptide is a portion of SEQ ID NO: 3; each start position is specified, the length of peptide is 10 amino acids, and the end position for each peptide is the start position plus nine.

| Pos | Subsequence | Score |
|---|---|---|
| 274 | LMPArAMVLV | 196.407 |
| 54 | ILPDeIFRLV | 184.215 |
| 701 | SLFSvVIVNL | 181.794 |
| 549 | ILDEnDDFTI | 168.703 |
| 53 | AILPdEIFRL | 144.981 |
| 510 | FTHNeYNFYV | 141.751 |
| 223 | KIHFsFSNLV | 127.193 |
| 279 | AMVLvNVTDV | 115.534 |
| 764 | VVVViFITAV | 90.423 |
| 99 | TLPAaVDPDV | 69.552 |
| 309 | VLSEnIPLNT | 51.940 |
| 67 | FLIEdINDNA | 45.911 |
| 548 | SILDeNDDFT | 41.891 |
| 273 | GLMPaRAMVL | 32.407 |
| 752 | KILVaAVAGT | 30.519 |
| 904 | QELPlDNTFV | 27.521 |
| 697 | GQPDsLFSVV | 22.523 |
| 299 | YIVNpVNDTV | 21.556 |
| 522 | NLPRhGTVGL | 21.362 |
| 761 | TITVvVVIFI | 18.417 |
| 625 | VLPStNPGTV | 15.371 |
| 822 | LLNFvTIEET | 14.277 |
| 387 | NQSAmLFIKV | 13.398 |
| 711 | FVNEsVTNAT | 12.298 |
| 703 | FSVViVNLFV | 11.487 |
| 696 | LGQPdSLFSV | 10.296 |
| 5 | LVYKtGDVPL | 10.169 |
| 767 | VIFItAVVRC | 9.882 |
| 672 | NITLmEKCDV | 9.563 |
| 855 | TMGKyNWVTT | 9.149 |
| 173 | AILQvSVTDT | 8.720 |
| 123 | VIFGlDVIET | 8.720 |
| 934 | CGYPvTTFEV | 8.427 |
| 489 | PLTSnVTVFV | 8.416 |
| 902 | IIQElPLDNT | 8.049 |
| 936 | YPVTtFEVPV | 7.936 |
| 145 | KELDrEEKDT | 7.693 |
| 646 | GMNAeVRTSI | 7.535 |
| 721 | LINElVRKST | 7.142 |
| 500 | IIDQnDNSPV | 6.503 |
| 590 | RVSRsSSAKV | 6.086 |

TABLE XI-continued

109P1D4v.1-A0201-
10-mers
Each peptide is a portion of SEQ
ID NO: 3; each start position is
specified, the length of peptide
is 10 amino acids, and the end
position for each peptide is the
start position plus nine.

| Pos | Subsequence | Score |
|-----|-------------|-------|
| 629 | TNPGtVVFQV  | 6.057 |
| 120 | KSQNiFGLDV  | 6.038 |
| 414 | SIPEnNSPGI  | 5.881 |
| 402 | NAPVfTQSFV  | 5.313 |
| 707 | IVNLfVNESV  | 5.069 |
| 321 | ALITvTDKDA  | 4.968 |
| 424 | QLTKvSAMDA  | 4.968 |
| 8   | KTGDvPLIRI  | 4.782 |
| 265 | LLVLaSDGGL  | 4.721 |
| 912 | FVACdSISKC  | 4.599 |
| 478 | FTILaKDNGV  | 4.444 |
| 853 | EQTMgKYNWV  | 4.363 |
| 680 | DVTDlGLHRV  | 4.304 |
| 230 | NLVSnIARRL  | 4.272 |
| 765 | VVVIfITAVV  | 4.242 |
| 300 | IVNPvNDTVV  | 4.242 |
| 197 | SIPEnAPVGT  | 4.201 |
| 603 | VVDVnDNKPV  | 4.138 |
| 624 | LVLPsTNPGT  | 4.101 |
| 209 | TQLHaTDADI  | 3.914 |
| 675 | LMEKcDVTDL  | 3.861 |
| 734 | VTPNtEIADV  | 3.777 |
| 636 | FQVIaVDNDT  | 3.476 |
| 339 | FTDHeIPFRL  | 3.166 |
| 454 | SLDCrTGMLT  | 2.981 |
| 313 | NIPLnTKIAL  | 2.937 |
| 109 | GINGvQNYEL  | 2.937 |
| 385 | PLNQsAMLFI  | 2.903 |
| 226 | FSFSnLVSNI  | 2.666 |
| 757 | AVAGtITVVV  | 2.495 |
| 370 | KEYAiKLLAA  | 2.488 |
| 440 | KINYILGPDA  | 2.391 |
| 118 | LIKSqNIFGL  | 2.331 |
| 291 | NVPSiDIRYI  | 2.310 |
| 753 | ILVAaVAGTI  | 2.306 |

TABLE XI-continued

109P1D4v.1-A0201-
10-mers
Each peptide is a portion of SEQ
ID NO: 3; each start position is
specified, the length of peptide
is 10 amino acids, and the end
position for each peptide is the
start position plus nine.

| Pos | Subsequence | Score |
|-----|-------------|-------|
| 632 | GTVVfQVIAV  | 2.222 |
| 929 | YSVSdCGYPV  | 2.088 |
| 377 | LAADaGKPPL  | 2.068 |
| 77  | PLFPaTVINI  | 1.953 |
| 647 | MNAEvRYSIV  | 1.946 |
| 842 | RVTLdLPIDL  | 1.869 |
| 307 | TVVLsENIPL  | 1.869 |
| 233 | SNIArPLFHL  | 1.860 |
| 316 | LNTKiALITV  | 1.775 |
| 435 | SGPNaKINYL  | 1.764 |
| 606 | VNDNkPVFIV  | 1.689 |
| 272 | GGLMpARAMV  | 1.680 |
| 819 | KNLLlNFVTI  | 1.676 |
| 930 | SVSDcGYPVT  | 1.644 |
| 938 | VTTFeVPVSV  | 1.642 |
| 755 | VAAVaGTITV  | 1.642 |
| 906 | LPLDnTFVAC  | 1.589 |
| 422 | GIQLtKVSAM  | 1.571 |
| 758 | VAGTiTVVVV  | 1.549 |
| 104 | VDPDvGINGV  | 1.549 |
| 605 | DVNDnDPVFI  | 1.544 |
| 620 | CSYElVLPST  | 1.468 |
| 430 | AMDAdSGPNA  | 1.435 |
| 85  | NISIpENSAI  | 1.435 |

TABLE XII

109P1D4v.1-
A3-9-mers
Each peptide is a portion of SEQ
ID NO: 3; each start position is
specified, the length of peptide is 9
amino acids, and the end position
for each peptide is the start
position plus eight.

| Pos | Subsequence | Score |
|-----|-------------|--------|
| 137 | KMPQLIVQK   | 90.000 |
| 375 | KLLAADAGK   | 90.000 |

TABLE XII-continued

109P1D4v.1-A3-9-mers
Each peptide is a portion of SEQ ID NO: 3; each start position is specified, the length of peptide is 9 amino acids, and the end position for each peptide is the start position plus eight.

| Pos | Subsequence | Score |
|---|---|---|
| 467 | KLDREKEDK | 90.000 |
| 720 | TLINELVRK | 45.000 |
| 112 | GVQNYELIK | 36.000 |
| 850 | DLEEQTMGK | 18.000 |
| 805 | IMMKKKKKK | 15.000 |
| 803 | QMIMMKKKK | 15.000 |
| 781 | HLKAAQKNK | 10.000 |
| 806 | MMKKKKKKK | 10.000 |
| 230 | NLVSNIARR | 9.000 |
| 460 | GMLTVVKKL | 6.075 |
| 602 | NVVDVNDNK | 4.500 |
| 61 | RLVKIRFLI | 4.050 |
| 247 | GLITIKEPL | 4.050 |
| 912 | FVACDSISK | 4.000 |
| 861 | WVTTPTTFK | 3.000 |
| 820 | NLLLNFVTI | 2.700 |
| 54 | ILPDEIFRL | 2.700 |
| 563 | GVIRPNISF | 2.700 |
| 387 | NQSAMLFIK | 2.700 |
| 244 | ATTGLITIK | 2.250 |
| 767 | VIFITAVVR | 2.000 |
| 590 | RVSRSSSAK | 2.099 |
| 8 | KTGDVPLIR | 1.800 |
| 53 | AILPDEIFR | 1.800 |
| 804 | MIMMKKKKK | 1.500 |
| 273 | GLMPARAMV | 1.350 |
| 356 | FLLETAAYL | 1.350 |
| 685 | GLHRVLVKA | 1.350 |
| 141 | LIVQKELDR | 1.200 |
| 291 | NVPSIDIRY | 1.200 |
| 274 | LMPARAMVL | 1.200 |
| 458 | RTGMLTWKI | 1.000 |
| 695 | DLGQPDSLF | 0.900 |
| 129 | VIETPEGDK | 0.900 |
| 855 | TMGKYNWVT | 0.900 |
| 761 | TITVVVVIF | 0.900 |
| 320 | ELIKSQNIF | 0.900 |
| 117 | ELIKSQNIF | 0.900 |
| 58 | EIFRLVKIR | 0.900 |
| 701 | SLFSVVIVN | 0.900 |
| 389 | SAMLFIKVK | 0.675 |
| 802 | RQMIMMKKK | 0.675 |
| 760 | GTITVVVVI | 0.608 |
| 719 | ATLINELVR | 0.600 |
| 210 | QLHATDADI | 0.600 |
| 614 | IVPPSNCSY | 0.600 |
| 489 | PLTSNVTVF | 0.600 |
| 953 | GIQVSNTTF | 0.600 |
| 39 | GIPRDEHCF | 0.600 |
| 462 | LTVVKKLDR | 0.600 |
| 25 | FTTGARIDR | 0.600 |
| 249 | ITIKEPLDR | 0.600 |
| 493 | NVTVFVSII | 0.540 |
| 223 | KIHFSFSNL | 0.540 |
| 576 | QESYTFYVK | 0.540 |
| 709 | NLFVNESVT | 0.500 |
| 238 | RLFHLNATT | 0.500 |
| 419 | NSPGIQLTK | 0.450 |
| 753 | KILVMVAGL | 0.450 |
| 891 | QPETPLNSK | 0.450 |
| 762 | ITVVVVIFI | 0.405 |
| 531 | PLNQSAMLF | 0.400 |
| 385 | PLNQSAMLF | 0.400 |
| 869 | DPDSPDLAR | 0.360 |
| 942 | EVPVSVHTR | 0.360 |
| 744 | SSPTSDYVK | 0.300 |
| 339 | FTDHEIPFR | 0.300 |
| 174 | ILQVSVTDT | 0.300 |
| 548 | SILDENDDF | 0.300 |

TABLE XII-continued

109P1D4v.1-A3-9-mers
Each peptide is a portion of SEQ ID NO: 3; each start position is specified, the length of peptide is 9 amino acids, and the end position for each peptide is the start position plus eight.

| Pos | Subsequence | Score |
|---|---|---|
| 368 | STKEYAIKL | 0.270 |
| 821 | LLLNFVTIE | 0.270 |
| 4 | KLVVKTGDV | 0.270 |
| 764 | VVVVIFITA | 0.270 |
| 234 | NIARRLFHL | 0.270 |
| 475 | KYLETILAK | 0.270 |
| 64 | KIRELIEDI | 0.270 |
| 680 | DVTDLGLHR | 0.240 |
| 476 | YLFTILAKD | 0.225 |
| 674 | TLMEKCDJT | 0.225 |
| 662 | DLFAIOQET | 0.225 |
| 872 | SPDLARHYK | 0.200 |
| 775 | RCRQAPHLK | 0.200 |
| 510 | FTHNEYNFY | 0.200 |
| 464 | VVKKLDREK | 0.200 |
| 779 | APHLKAAQK | 0.200 |
| 684 | LGLHRVLVK | 0.180 |
| 454 | SLDCRTGML | 0.180 |
| 158 | KVKVEDGGF | 0.180 |
| 633 | TWFQVIAVJ | 0.180 |
| 769 | FITAVVRCR | 0.180 |
| 598 | KVTINVVDV | 0.180 |
| 742 | DVSSPTSDY | 0.180 |
| 241 | HLNATTGLI | 0.180 |
| 308 | VVLSENIPL | 0.182 |
| 575 | KQESYTFYV | 0.162 |
| 391 | MLFIKVKDE | 0.150 |
| 910 | NTFVACDSL | 0.150 |
| 628 | STNPGTVVF | 0.150 |

TABLE XIII

109P1D4v1-A3-10-mers
Each peptide is a portion of SEQ ID NO: 3; each start position is specified, the length of peptide is 10 amino acids, and the end position for each peptide is the start position plus nine.

| Pos | Subsequence | Score |
|---|---|---|
| 683 | DLGLhRVLVK | 36.000 |
| 319 | KIALiTVTDK | 18.000 |
| 530 | GLITvTDPDY | 18.000 |
| 575 | KQESyTFYVK | 16.200 |
| 803 | QMIMmKKKKK | 15.000 |
| 805 | IMMkKKKKKK | 15.000 |
| 140 | QLIVqKELDR | 12.000 |
| 467 | KLDReKEDKY | 12.000 |
| 806 | MMKKkKKKKK | 10.000 |
| 347 | RLRPvFSNQF | 9.000 |
| 646 | GMNAeVRYSI | 8.100 |
| 273 | GLMPaRAMVL | 8.100 |
| 461 | MLTVvKKLDR | 8.000 |
| 357 | LLETaAYLDY | 8.000 |
| 701 | SLFSvVIVNL | 6.750 |
| 160 | KVEDgGFPQR | 3.600 |
| 361 | AAYLdYESTK | 3.000 |
| 444 | LLGPdAPPEF | 3.000 |
| 458 | RTGMlTVVKK | 3.000 |
| 549 | ILDEnDDFTI | 2.700 |
| 77 | PLFPaTVINI | 2.700 |
| 564 | VIRPnISFDR | 2.700 |
| 719 | ATLInELVRK | 2.250 |
| 890 | IQPEtPLNSK | 2.025 |
| 760 | GTITvVVVIF | 2.025 |
| 363 | YLDYeSTKEY | 2.000 |
| 675 | LMEKcDVTDL | 1.800 |
| 55 | LPDEiFRLVK | 1.800 |
| 804 | MIMMkKKKKK | 1.500 |
| 39 | GIPRdEHCFY | 1.200 |
| 146 | ELDReEKDTY | 1.200 |
| 669 | ETGNiTLMEK | 0.900 |
| 613 | FIVPpSNCSY | 0.900 |
| 58 | EIFRlVKIRF | 0.900 |
| 143 | VQKElDREEK | 0.900 |
| 279 | AMVLvNVTDV | 0.900 |

TABLE XIII-continued

109P1D4v1-A3-10-mers
Each peptide is a portion of SEQ ID NO: 3; each start position is specified, the length of peptide is 10 amino acids, and the end position for each peptide is the start position plus nine.

| Pos | Subsequence | Score |
|---|---|---|
| 109 | GINGvQNYEL | 0.810 |
| 850 | DLEEqTMGKY | 0.810 |
| 248 | LITIkEPLDR | 0.800 |
| 67 | FLIEdINDNA | 0.675 |
| 53 | AILPdEIFRL | 0.608 |
| 128 | DVIEtPEGDK | 0.608 |
| 766 | VVIFiTAVVR | 0.600 |
| 522 | NLPRhGTVGL | 0.600 |
| 354 | NQFLlETAAY | 0.600 |
| 761 | TITVvVVIFI | 0.540 |
| 309 | VLSEnIPLNT | 0.450 |
| 802 | RQMImMKKKK | 0.450 |
| 123 | NIFGlDVIET | 0.450 |
| 743 | VSSPtSDYVK | 0.450 |
| 753 | ILVAaVAGTI | 0.405 |
| 8 | KTGDvPLIRI | 0.405 |
| 557 | TIDSqTGVIR | 0.400 |
| 424 | QLTKvSAMDA | 0.400 |
| 107 | DVGInGVQNY | 0.360 |
| 939 | TTFEvPVSVH | 0.338 |
| 88 | IPENsAINSK | 0.300 |
| 243 | NATTgLITIK | 0.300 |
| 655 | IVGGnTRDLF | 0.300 |
| 823 | LNFVtIEETK | 0.300 |
| 16 | RIEEdTGEIF | 0.300 |
| 5 | LVYKtGDVPL | 0.300 |
| 274 | LMPArAMVLV | 0.300 |
| 767 | VIFItAVVRC | 0.300 |
| 181 | DTNDnHPVFK | 0.300 |
| 463 | TVVKkLDREK | 0.300 |
| 99 | TLPAaVDPDV | 0.300 |
| 508 | PVFThNEYNF | 0.300 |
| 763 | TVVVvIFITA | 0.270 |
| 137 | KMPQlIVQKE | 0.270 |
| 632 | GTVVfQVIAV | 0.270 |
| 265 | LLVLaSDGGL | 0.270 |
| 820 | NLLLnFVTIE | 0.270 |
| 118 | LIKSqNIFGL | 0.270 |
| 310 | LSENiPLNTK | 0.225 |
| 388 | QSAMlFIKVK | 0.225 |
| 241 | HLNAtTGLIT | 0.200 |
| 337 | TCFTdHEIPF | 0.200 |
| 430 | AMDAdSGPNA | 0.200 |
| 778 | QAPHlKAAQK | 0.200 |
| 454 | SLDCrTGMLT | 0.200 |
| 386 | LNQSaMLFIK | 0.180 |
| 418 | NNSPgIQLTK | 0.180 |
| 111 | NGVQnYELIK | 0.180 |
| 905 | ELPLdNTFVA | 0.180 |
| 217 | DIGEnAKIHF | 0.180 |
| 307 | TVVLsENIPL | 0.180 |
| 385 | PLNQsAMLFI | 0.180 |
| 61 | RLVKiRFLIE | 0.180 |
| 223 | KIHFsFSNLV | 0.180 |
| 422 | GIQLtKVSAM | 0.180 |
| 866 | TTFKpDSPDL | 0.150 |
| 822 | LLNFvTIEET | 0.150 |
| 391 | MLFIkVKDEN | 0.150 |
| 26 | TTGArIDREK | 0.150 |
| 321 | ALITvTDKDA | 0.150 |
| 339 | FTDHeIPFRL | 0.135 |
| 230 | NLVSnIARRL | 0.135 |
| 356 | FLLEtAAYLD | 0.135 |
| 764 | VVVViFITAV | 0.135 |

TABLE XIV

109P1D4v.1-A1101-9-mers
Each peptide is a portion of SEQ ID NO: 3; each start position is specified, peptide length of 9 amino acids, and the end position for each peptide is the start position plus eight.

| Pos | Subsequence | Score |
|---|---|---|
| 112 | GVQNYELIK | 12.000 |
| 590 | RVSRSSSAK | 6.000 |

TABLE XIV-continued

109P1D4v.1-A1101-9-mers
Each peptide is a portion of SEQ ID NO: 3;
each start position is specified, peptide
length of 9 amino acids, and the end position
for each peptide is the start position plus eight.

| Pos | Subsequence | Score |
|---|---|---|
| 912 | FVACDSISK | 4.000 |
| 475 | KYLFTILAK | 3.600 |
| 458 | RTGMLTVVK | 3.000 |
| 602 | NVVDVNDNK | 2.000 |
| 861 | WVTTPTTFK | 2.000 |
| 387 | NQSAMLFIK | 1.800 |
| 375 | KLLAADAGK | 1.800 |
| 802 | RQMIMMKKK | 1.800 |
| 137 | KMPQLIVQK | 1.200 |
| 467 | KLDREKEDK | 1.200 |
| 8 | KTGDVPLIR | 1.200 |
| 244 | ATTGLITIK | 1.000 |
| 462 | LTVVKKLDR | 0.600 |
| 720 | TLINELVRK | 0.600 |
| 249 | ITIKEPLDR | 0.600 |
| 775 | RCRQAPHLK | 0.600 |
| 719 | ATLINELVR | 0.600 |
| 362 | AYLDYESTK | 0.600 |
| 25 | FTTGARIDR | 0.400 |
| 805 | IMMKKKKKK | 0.400 |
| 804 | MIMMKKKKK | 0.400 |
| 582 | YVKAEDGGR | 0.400 |
| 129 | VIETPEGDK | 0.400 |
| 320 | IALITVTDK | 0.300 |
| 803 | QMIMMKKKK | 0.300 |
| 824 | NFVTIEETK | 0.300 |
| 680 | DVTDLGLHR | 0.240 |
| 869 | KPDSPDLAR | 0.240 |
| 53 | AILPDEIFR | 0.240 |
| 850 | DLEEQTMGK | 0.240 |
| 141 | LIVQKELDR | 0.240 |
| 517 | FYVPENLPR | 0.240 |
| 389 | SAMLFIKVK | 0.200 |
| 781 | HLKAAQKNK | 0.200 |
| 872 | SPDLARHYK | 0.200 |
| 806 | MMKKKKKKK | 0.200 |

TABLE XIV-continued

109P1D4v.1-A1101-9-mers
Each peptide is a portion of SEQ ID NO: 3;
each start position is specified, peptide
length of 9 amino acids, and the end position
for each peptide is the start position plus eight.

| Pos | Subsequence | Score |
|---|---|---|
| 779 | APHLKAAQK | 0.200 |
| 891 | QPETPLNSK | 0.200 |
| 339 | FTDHEIPFR | 0.200 |
| 464 | VVKKLDREK | 0.200 |
| 563 | GVIRPNISF | 0.180 |
| 767 | VIFITAVVR | 0.160 |
| 576 | QESYTFYVK | 0.120 |
| 230 | NLVSNIARR | 0.120 |
| 942 | EVPVSVHTR | 0.120 |
| 688 | RVLVKANDL | 0.090 |
| 811 | KKKKKHSPK | 0.060 |
| 684 | LGLHRVLVK | 0.060 |
| 311 | SENIPLNTK | 0.060 |
| 598 | KVTINVVDV | 0.060 |
| 215 | DADIGENAK | 0.060 |
| 764 | VVVVIFITA | 0.060 |
| 644 | DTGMNAEVR | 0.060 |
| 704 | SVVIVNLFV | 0.060 |
| 486 | GVPPLTSNV | 0.060 |
| 432 | DADSGPNAK | 0.060 |
| 395 | KVKDENDNA | 0.060 |
| 633 | TVVFQVIAV | 0.060 |
| 205 | GTSVTQLHA | 0.060 |
| 158 | KVKVEDGGF | 0.060 |
| 308 | VVLSENIPL | 0.060 |
| 61 | RLVKIRFLI | 0.054 |
| 697 | GQPDSLFSV | 0.054 |
| 575 | KQESYTFYV | 0.054 |
| 22 | GEIFTTGAR | 0.054 |
| 760 | GTITVVVVI | 0.045 |
| 632 | GTVVFQVIA | 0.045 |
| 930 | SVSDCGYPV | 0.040 |
| 801 | NRQMIMMKK | 0.040 |
| 744 | SSPTSDYVK | 0.040 |
| 670 | TGNITLMEK | 0.040 |
| 419 | NSPGIQLTK | 0.040 |

TABLE XIV-continued

109P1D4v.1-A1101-9-mers
Each peptide is a portion of SEQ ID NO: 3;
each start position is specified, peptide
length of 9 amino acids, and the end position
for each peptide is the start position plus eight.

| Pos | Subsequence | Score |
|-----|-------------|-------|
| 182 | TNDNHPVFK | 0.040 |
| 291 | NVPSIDIRY | 0.040 |
| 794 | WATPNPENR | 0.040 |
| 459 | TGMLTVVKK | 0.040 |
| 935 | GYPVTTFEV | 0.036 |
| 152 | KDTYVMKVK | 0.030 |
| 843 | VTLDLPIDL | 0.030 |
| 766 | VVIFITAVV | 0.030 |
| 280 | MVLVNVTDV | 0.030 |
| 266 | LVLASDGGL | 0.030 |
| 762 | ITVVVVIFI | 0.030 |
| 765 | VVVIFITAV | 0.030 |
| 229 | SNLVSNIAR | 0.024 |
| 58 | EIFRLVKIR | 0.024 |
| 30 | RIDREKLCA | 0.024 |
| 273 | GLMPARAMV | 0.024 |
| 800 | ENRQMIMMK | 0.024 |
| 939 | TTFEVPVSV | 0.020 |
| 614 | IVPPSNCSY | 0.020 |
| 324 | TVTDKDADH | 0.020 |
| 754 | LVAAVAGTI | 0.020 |
| 368 | STKEYAIKL | 0.020 |
| 73 | VVRCRQAPH | 0.020 |
| 946 | SVHTRPVGI | 0.020 |
| 757 | AVAGTITVV | 0.020 |
| 750 | YVKILVAAV | 0.020 |

TABLE XV

109P1D4v.1-A1101-10-mers
Each peptide is a portion of SEQ ID NO: 3;
each start position is specified, the length
of peptide is 10 amino acids, and the end position
for each peptide is the start position plus nine.

| Pos | Subsequence | Score |
|-----|-------------|-------|
| 575 | KQESyTFYVK | 3.600 |
| 458 | RTGMlTVVKK | 3.000 |
| 802 | RQMImMKKKK | 1.800 |
| 719 | ATLInELVRK | 1.500 |
| 319 | KIALiTVTDK | 1.200 |
| 160 | KVEDgGFPQR | 1.200 |
| 128 | DVIEtPEGDK | 0.900 |
| 766 | VVIFiTAVVR | 0.600 |
| 669 | ETGNiTLMEK | 0.600 |
| 911 | TFVAcDSISK | 0.600 |
| 143 | VQKElDREEK | 0.600 |
| 890 | IQPEtPLNSK | 0.600 |
| 804 | MIMMkKKKKK | 0.400 |
| 805 | IMMKkKKKKK | 0.400 |
| 361 | AAYLdYESTK | 0.400 |
| 55 | LPDEiFRLVK | 0.400 |
| 181 | DTNDnHPVFK | 0.300 |
| 463 | TVVKkLDREK | 0.300 |
| 803 | QMIMmKKKKK | 0.300 |
| 564 | VIRPnISFDR | 0.240 |
| 140 | QLIVqKELDR | 0.240 |
| 652 | RYSIvGGNTR | 0.240 |
| 683 | DLGLhRVLVK | 0.240 |
| 778 | QAPHlKAAQK | 0.200 |
| 88 | IPENsAINSK | 0.200 |
| 243 | NATTgLITIK | 0.200 |
| 806 | MMKKkKKKKK | 0.200 |
| 149 | REEKdTYVMK | 0.180 |
| 461 | MLTVvKKLDR | 0.160 |
| 516 | NFYVpENLPR | 0.160 |
| 248 | LITIkEPLDR | 0.160 |
| 386 | LNQSaMLFIK | 0.120 |
| 581 | FYVKaEDGGR | 0.120 |
| 842 | RVTLdLPIDL | 0.120 |
| 52 | VAILpDEIFR | 0.120 |
| 584 | KAEDgGRVSR | 0.120 |
| 26 | TTGArIDREK | 0.100 |
| 589 | GRVSrSSSAK | 0.090 |
| 466 | KKLDrEKEDK | 0.090 |

TABLE XV-continued

109P1D4v.1-A1101-10-mers
Each peptide is a portion of SEQ ID NO: 3;
each start position is specified, the length
of peptide is 10 amino acids, and the end position
for each peptide is the start position plus nine.

| Pos | Subsequence | Score |
|---|---|---|
| 632 | GTVVfQVIAV | 0.090 |
| 718 | NATLiNELVR | 0.080 |
| 24 | IFTTgARIDR | 0.080 |
| 557 | TIDSqTGVIR | 0.080 |
| 418 | NNSPgIQLTK | 0.080 |
| 823 | LNFVtIEETK | 0.080 |
| 33 | REKLcAGIPR | 0.072 |
| 566 | RPNIsFDREK | 0.060 |
| 111 | NGVQnYELIK | 0.060 |
| 849 | IDLEeQTMGK | 0.060 |
| 601 | INVVdVNDNK | 0.060 |
| 810 | KKKKkKHSPK | 0.060 |
| 366 | YESTkEYAIK | 0.060 |
| 8 | KTGDvPLIRI | 0.060 |
| 335 | RVTCfTDHEI | 0.060 |
| 307 | TVVLsENIPL | 0.060 |
| 763 | TVVVvIFITA | 0.060 |
| 590 | RVSRsSSAKV | 0.060 |
| 273 | GLMPaRAMVL | 0.048 |
| 760 | GTITvVVVIF | 0.045 |
| 640 | AVDNdTGMNA | 0.040 |
| 449 | APPEfSLDCR | 0.040 |
| 5 | LVYKtGDVPL | 0.040 |
| 743 | VSSPtSDYVK | 0.040 |
| 338 | CFTDhEIPFR | 0.040 |
| 374 | IKLLaADAGK | 0.030 |
| 860 | NWVTtPTTFK | 0.030 |
| 764 | VVVViFITAV | 0.030 |
| 339 | FTDHeIPFRL | 0.030 |
| 772 | AVVRcRQAPH | 0.030 |
| 266 | LVLAsDGGLM | 0.030 |
| 510 | FTHNeYNFYV | 0.030 |
| 765 | VVVIfITAVV | 0.030 |
| 349 | RPVFsNQFLL | 0.027 |
| 109 | GINGvQNYEL | 0.024 |
| 646 | GMNAeVRYSI | 0.024 |

TABLE XV-continued

109P1D4v.1-A1101-10-mers
Each peptide is a portion of SEQ ID NO: 3;
each start position is specified, the length
of peptide is 10 amino acids, and the end position
for each peptide is the start position plus nine.

| Pos | Subsequence | Score |
|---|---|---|
| 800 | ENRQmIMMKK | 0.024 |
| 474 | DKYLfTILAK | 0.024 |
| 431 | MDADsGPNAK | 0.020 |
| 214 | TDADiGENAK | 0.020 |
| 757 | AVAGtITVVV | 0.020 |
| 300 | IVNPvNDTVV | 0.020 |
| 774 | VRCRqAPHLK | 0.020 |
| 707 | IVNLfVNESV | 0.020 |
| 750 | YVKIlVAAVA | 0.020 |
| 255 | LDREeTPNHK | 0.020 |
| 866 | TTFKpDSPDL | 0.020 |
| 207 | SVTQlHATDA | 0.020 |
| 939 | TTFEvPVSVH | 0.020 |
| 457 | CRTGmLTVVK | 0.020 |
| 725 | LVRKsTEAPV | 0.020 |
| 582 | YVKAeDGGRV | 0.020 |
| 655 | IVGGnTRDLF | 0.020 |
| 773 | VVRCrQAPHL | 0.020 |
| 310 | LSENiPLNTK | 0.020 |
| 530 | GLITvTDPDY | 0.018 |
| 446 | GPDApPEFSL | 0.018 |
| 697 | GQPDsLFSVV | 0.018 |
| 53 | AILPdEIFRL | 0.018 |
| 941 | FEVPvSVHTR | 0.018 |
| 556 | FTIDsQTGVI | 0.015 |

TABLE XVI

109P1D4v.1-A24-9-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 47 | FYEVEVAIL | 300.000 |
| 6 | VYKTGDVPL | 200.000 |
| 702 | LFSVVIVNL | 28.000 |
| 867 | TFKPDSPDL | 24.000 |
| 858 | KYNWVTTPT | 21.000 |

TABLE XVI-continued

109P1D4v.1-A24-9-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 349 | RPVFSNQFL | 14.400 |
| 688 | RVLVKANDL | 14.400 |
| 59 | IFRLVKIRF | 14.000 |
| 652 | RYSIVGGNT | 14.000 |
| 338 | CFTDHEIPF | 12.000 |
| 621 | SYELVLPST | 10.500 |
| 749 | DYVKILVAA | 10.500 |
| 115 | NYELIKSQN | 10.500 |
| 509 | VFTHNEYNF | 10.000 |
| 223 | KIHFSFSNL | 9.600 |
| 460 | GMLTVVKKL | 9.240 |
| 843 | VTLDLPIDL | 8.640 |
| 46 | CFYEVEVAI | 8.400 |
| 839 | DGNRVTLDL | 8.400 |
| 247 | GLITIKEPL | 8.400 |
| 935 | GYPVTTFEV | 8.250 |
| 514 | EYNFYVPEN | 8.250 |
| 678 | KCDVTDLGL | 8.000 |
| 78 | LFPATVINI | 7.500 |
| 365 | DYESTKEYA | 7.500 |
| 436 | GPNAKINYL | 7.200 |
| 54 | ILPDEIFRL | 7.200 |
| 356 | FLLETAAYL | 7.200 |
| 717 | TNATLINEL | 6.336 |
| 667 | DQETGNITL | 6.000 |
| 274 | LMPARAMVL | 6.000 |
| 417 | ENNSPGIQL | 6.000 |
| 314 | IPLNTKIAL | 6.000 |
| 302 | NPVNDTVVL | 6.000 |
| 308 | VVLSENIPL | 6.000 |
| 92 | SAINSKYTL | 6.000 |
| 538 | DYGDNSAVT | 6.000 |
| 260 | TPNHKLLVL | 6.000 |
| 888 | FQIQPETPL | 6.000 |
| 227 | SFSNLVSNI | 6.000 |
| 266 | LVLASDGGL | 6.000 |

TABLE XVI-continued

109P1D4v.1-A24-9-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 231 | LVSNIARRL | 5.600 |
| 515 | YNFYVPENL | 5.600 |
| 368 | STKEYAIKL | 5.280 |
| 703 | FSVVIVNLF | 5.040 |
| 371 | EYAIKLLAA | 5.000 |
| 110 | INGVQNYEL | 4.400 |
| 28 | GARIDREKL | 4.400 |
| 61 | RLVKIRFLI | 4.200 |
| 378 | AADAGKPPL | 4.000 |
| 837 | DSDGNRVTL | 4.000 |
| 880 | KSASPQPAF | 4.000 |
| 655 | IVGGNTRDL | 4.000 |
| 539 | YGDNSAVTL | 4.000 |
| 234 | NIARRLFHL | 4.000 |
| 618 | SNCSYELVL | 4.000 |
| 542 | NSAVTLSIL | 4.000 |
| 454 | SLDCRTGML | 4.000 |
| 158 | KVKVEDGGF | 4.000 |
| 523 | LPRHGTVGL | 4.000 |
| 16 | RIEEDTGEI | 3.960 |
| 445 | LGPDAPPEF | 3.960 |
| 502 | DQNDNSPVF | 3.600 |
| 548 | SILDENDDF | 3.600 |
| 117 | ELIKSQNIF | 3.600 |
| 605 | DVNDNKPVF | 3.600 |
| 402 | NAPVFTQSF | 3.600 |
| 181 | DTNDNHPVF | 3.600 |
| 71 | DINDNAPLF | 3.600 |
| 628 | STNPGTVVF | 3.600 |
| 860 | NWVTTPTTF | 3.000 |
| 39 | GIPRDEHCF | 3.000 |
| 52 | VAILPDEIF | 3.000 |
| 563 | GVIRPNISF | 3.000 |
| 232 | VSNIARRLF | 3.000 |
| 218 | IGENAKIHF | 3.000 |
| 953 | GIQVSNTTF | 3.000 |

TABLE XVI-continued

109P1D4v.1-A24-9-mers
Each peptide is a portion of SEQ ID NO: 3; each start position is specified, the length of peptide is 9 amino acids, and the end position for each peptide is the start position plus eight.

| Pos | Subsequence | Score |
|---|---|---|
| 220 | ENAKIHFSF | 2.800 |
| 761 | TITVVVIF | 2.800 |
| 492 | SNVTVFVSI | 2.520 |
| 64 | KIRFLIEDI | 2.400 |
| 344 | IPFRLRPVF | 2.400 |
| 817 | SPKNLLLNF | 2.400 |
| 312 | ENIPLNTKI | 2.376 |
| 760 | GTITVVVVI | 2.100 |
| 762 | ITVVVIFI | 2.100 |
| 695 | DLGQPDSLF | 2.000 |
| 656 | VGGNTRDLF | 2.000 |
| 933 | DCGYPVTTF | 2.000 |
| 593 | RSSSAKVTI | 2.000 |
| 86 | ISIPENSAI | 1.800 |
| 306 | DTVVLSENI | 1.800 |
| 287 | DVNDNVPSI | 1.800 |
| 102 | AAVDPDVGI | 1.800 |
| 820 | NLLLNFVTI | 1.800 |
| 647 | MNAEVRYSI | 1.680 |
| 186 | HPVFKETEI | 1.650 |
| 732 | APVTPNTEI | 1.650 |
| 111 | NGVQNYELI | 1.500 |
| 166 | FPQRSSTAI | 1.500 |

TABLE XVII

109P1D4v.1-A24—10-mers
Each peptide is a portion of SEQ ID NO: 3; each start position is specified, the length of peptide is 10 amino acids, and the end position for each peptide is the start position plus nine.

| Pos | Subsequence | Score |
|---|---|---|
| 514 | EYNFyVPENL | 420.000 |
| 538 | DYGDnSAVTL | 240.000 |
| 115 | NYELiKSQNI | 90.000 |
| 365 | DYEStKEYAI | 75.000 |
| 6 | VYKTgDVPLI | 50.000 |
| 887 | AFQIqPETPL | 30.000 |

TABLE XVII-continued

109P1D4v.1-A24—10-mers
Each peptide is a portion of SEQ ID NO: 3; each start position is specified, the length of peptide is 10 amino acids, and the end position for each peptide is the start position plus nine.

| Pos | Subsequence | Score |
|---|---|---|
| 355 | QFLLeTAAYL | 30.000 |
| 46 | CFYEvEVAIL | 24.000 |
| 239 | LFHLnATTGL | 20.000 |
| 59 | IFRLvKIRFL | 20.000 |
| 298 | RYIVnPVNDT | 18.000 |
| 702 | LFSVvIVNLF | 16.800 |
| 858 | KYNWvTTPTT | 15.000 |
| 349 | RPVFsNQFLL | 12.000 |
| 383 | KPPLnQSAML | 12.000 |
| 842 | RVTLdLPIDL | 9.600 |
| 716 | VTNAtLINEL | 9.504 |
| 459 | TGMLtVVKKL | 9.240 |
| 138 | MPQLiVQKEL | 9.240 |
| 621 | SYELvLPSTN | 9.000 |
| 749 | DYVKiLVAAV | 9.000 |
| 246 | TGLItIKEPL | 8.400 |
| 230 | NLVSnIARRL | 8.400 |
| 436 | GPNAkINYLL | 8.400 |
| 165 | GFPQrSSTAI | 7.500 |
| 897 | NSKHhIIQEL | 7.392 |
| 16 | RIEEdTGEIF | 7.200 |
| 53 | AILPdEIFRL | 7.200 |
| 435 | SGPNaKINYL | 7.200 |
| 273 | GLMPaRAMVL | 7.200 |
| 453 | FSLDcRTGML | 7.200 |
| 615 | VPPSnCSYEL | 6.600 |
| 109 | GINGvQNYEL | 6.600 |
| 313 | NIPLnTKIAL | 6.000 |
| 878 | HYKSaSPQPA | 6.000 |
| 712 | VNESvTNATL | 6.000 |
| 522 | NLPRhGTVGL | 6.000 |
| 307 | TVVLsENIPL | 6.000 |
| 265 | LLVLaSDGGL | 6.000 |
| 166 | FPQRsSTAIL | 6.000 |
| 675 | LMEKcDVTDL | 6.000 |
| 202 | APVGtSVTQL | 6.000 |

TABLE XVII-continued

109P1D4v.1-A24—10-mers
Each peptide is a portion of SEQ ID NO: 3;
each start position is specified, the length
of peptide is 10 amino acids, and the end position
for each peptide is the start position plus nine.

| Pos | Subsequence | Score |
|---|---|---|
| 233 | SNIArRLFHL | 6.000 |
| 301 | VNPVnDTVVL | 6.000 |
| 259 | ETPNhKLLVL | 6.000 |
| 132 | TPEGdKMPQL | 6.000 |
| 654 | SIVGgNTRDL | 6.000 |
| 347 | RLRPvFSNQF | 5.760 |
| 701 | SLFSvVIVNL | 5.600 |
| 339 | FTDHeIPFRL | 5.600 |
| 481 | LAKDnGVPPL | 4.800 |
| 377 | LAADaGKPPL | 4.800 |
| 681 | VTDLgLHRVL | 4.800 |
| 368 | STKEyAIKLL | 4.800 |
| 27 | TGARiDREKL | 4.400 |
| 367 | ESTKeYAIKL | 4.400 |
| 903 | IQELpLDNTF | 4.320 |
| 760 | GTITvVVVIF | 4.200 |
| 773 | VVRCrQAPHL | 4.000 |
| 91 | NSAInSKYTL | 4.000 |
| 866 | TTFKpDSPDL | 4.000 |
| 118 | LIKSqNIFGL | 4.000 |
| 693 | ANDLgQPDSL | 4.000 |
| 446 | GPDApPEFSL | 4.000 |
| 541 | DNSAvTLSIL | 4.000 |
| 5 | LVYKtGDVPL | 4.000 |
| 745 | SPTSdYVKIL | 4.000 |
| 38 | AGIPrDEHCF | 3.600 |
| 816 | HSPKnLLLNF | 3.600 |
| 819 | KNLLlNFVTI | 3.600 |
| 343 | EIPFrLRPVF | 3.600 |
| 547 | LSILdENDDF | 3.000 |
| 952 | VGIQvSNTTF | 3.000 |
| 562 | TGVIrPNISF | 3.000 |
| 401 | DNAPvFTQSF | 2.880 |
| 58 | EIFRlVKIRF | 2.800 |
| 444 | LLGPdAPPEF | 2.640 |
| 491 | TSNVtVFVSI | 2.520 |

TABLE XVII-continued

109P1D4v.1-A24—10-mers
Each peptide is a portion of SEQ ID NO: 3;
each start position is specified, the length
of peptide is 10 amino acids, and the end position
for each peptide is the start position plus nine.

| Pos | Subsequence | Score |
|---|---|---|
| 452 | EFSLdCRTGM | 2.500 |
| 217 | DIGEnAKIHF | 2.400 |
| 8 | KTGDvPLIRI | 2.400 |
| 475 | KYLEtILAKD | 2.310 |
| 335 | RVTCfTDHEI | 2.200 |
| 796 | TPNPeNRQMI | 2.160 |
| 646 | GMNAeVRYSI | 2.100 |
| 406 | FTQSfVTVSI | 2.100 |
| 753 | ILVAaVAGTI | 2.100 |
| 630 | NPGTvVFQVI | 2.016 |
| 655 | IVGGnTRDLF | 2.000 |
| 337 | TCFTdHEIPF | 2.000 |
| 51 | EVAIlPDEIF | 2.000 |
| 231 | LVSNiARRLF | 2.000 |
| 859 | YNWVtTPTTF | 2.000 |
| 556 | FTIDsQTGVI | 1.800 |
| 605 | DVNDnKPVFI | 1.800 |
| 664 | FAIDqETGNI | 1.800 |
| 66 | RFLIeDINDN | 1.800 |
| 414 | SIPEnNSPGI | 1.800 |
| 731 | EAPVtPNTEI | 1.650 |
| 744 | SSPTsDYVKI | 1.650 |

TABLE XVIII

109P1D4v.1-B7 9-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 523 | LPRHGTVGL | 800.000 |
| 28 | GARIDREKL | 180.000 |
| 349 | RPVFSNQFL | 80.000 |
| 314 | IPLNTKIAL | 80.000 |
| 436 | GPNAKINYL | 80.000 |
| 260 | TPNHKLLVL | 80.000 |
| 302 | NPVNDTVVL | 80.000 |
| 732 | APVTPNTEI | 36.000 |

TABLE XVIII-continued

109P1D4v.1-B7 9-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 76  | APLFPATVI | 36.000 |
| 796 | TPNPENRQM | 20.000 |
| 655 | IVGGNTRDL | 20.000 |
| 688 | RVLVKANDL | 20.000 |
| 308 | VVLSENIPL | 20.000 |
| 231 | LVSNIARRL | 20.000 |
| 383 | KPPLNQSAM | 20.000 |
| 266 | LVLASDGGL | 20.000 |
| 92  | SAINSKYTL | 12.000 |
| 403 | APVFTQSFV | 12.000 |
| 378 | AADAGKPPL | 10.800 |
| 166 | FPQRSSTAI | 8.000 |
| 745 | SPTSDYVKI | 8.000 |
| 384 | PPLNQSAML | 8.000 |
| 186 | HPVFKETEI | 8.000 |
| 292 | VPSIDIRYI | 8.000 |
| 894 | TPLNSKHHI | 8.000 |
| 616 | PPSNCSYEL | 8.000 |
| 888 | FQIQPETPL | 6.000 |
| 449 | APPEFSLDC | 6.000 |
| 417 | ENNSPGIQL | 6.000 |
| 798 | NPENRQMIM | 6.000 |
| 102 | AAVDPDVGI | 5.400 |
| 735 | TPNTEIADV | 4.000 |
| 839 | DGNRVTLDL | 4.000 |
| 630 | NPGTVVFQV | 4.000 |
| 275 | MPARAMVLV | 4.000 |
| 460 | GMLTVVKKL | 4.000 |
| 274 | LMPARAMVL | 4.000 |
| 618 | SNCSYELVL | 4.000 |
| 223 | KIHFSFSNL | 4.000 |
| 368 | STKEYAIKL | 4.000 |
| 167 | PQRSSTAIL | 4.000 |
| 54  | ILPDEIFRL | 4.000 |
| 420 | SPGIQLTKV | 4.000 |
| 64  | KIRFLIEDI | 4.000 |

TABLE XVIII-continued

109P1D4v.1-B7 9-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 356 | FLLETAAYL | 4.000 |
| 626 | LPSTNPGTV | 4.000 |
| 843 | VTLDLPIDL | 4.000 |
| 542 | NSAVTLSIL | 4.000 |
| 234 | NIARRLFHL | 4.000 |
| 40  | IPRDEHCFY | 4.000 |
| 100 | LPAAVDPDV | 4.000 |
| 515 | YNFYVPENL | 4.000 |
| 717 | TNATLINEL | 4.000 |
| 247 | GLITIKEPL | 4.000 |
| 110 | INGVQNYEL | 4.000 |
| 757 | AVAGTITVV | 4.000 |
| 639 | IAVDNDTGM | 3.000 |
| 415 | IPENNSPGI | 2.400 |
| 203 | PVGTSVTQL | 2.000 |
| 906 | LPLDNTFVA | 2.000 |
| 946 | SVHTRPVGI | 2.000 |
| 296 | DIRYIVNPV | 2.000 |
| 287 | DVNDNVPSI | 2.000 |
| 350 | PVFSNQFLL | 2.000 |
| 754 | LVAAVAGTI | 2.000 |
| 456 | DCRTGMLTV | 2.000 |
| 493 | NVTVFVSII | 2.000 |
| 487 | VPPLTSNVT | 2.000 |
| 51  | EVAILPDEI | 2.000 |
| 948 | HTRPVGIQV | 2.000 |
| 847 | LPIDEEQT  | 2.000 |
| 591 | VSRSSSAKV | 2.000 |
| 882 | ASPQPAFQI | 1.800 |
| 756 | AAVAGTITV | 1.800 |
| 837 | DSDGNRVTL | 1.800 |
| 272 | GGLMPARAM | 1.500 |
| 453 | FSLDCRTGM | 1.500 |
| 678 | KCDVTDLGL | 1.200 |
| 243 | NATTGLITI | 1.200 |
| 105 | DPDVGINGV | 1.200 |

TABLE XVIII-continued

109P1D4v.1-B7 9-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 698 | QPDSLFSVV | 1.200 |
| 539 | YGDNSAVTL | 1.200 |
| 667 | DQETGNITL | 1.200 |
| 454 | SLDCRTGML | 1.200 |
| 55 | LPDEIFRLV | 1.200 |
| 284 | NVTDVNDNV | 1.000 |
| 633 | TVVFQVIAV | 1.000 |
| 280 | MVLVNVTDV | 1.000 |
| 750 | YVKILVAAV | 1.000 |
| 766 | VVIFITAVV | 1.000 |
| 930 | SVSDCGYPV | 1.000 |
| 486 | GVPPLTSNV | 1.000 |
| 765 | VVVIFITAV | 1.000 |
| 300 | IVNPVNDTV | 1.000 |
| 598 | KVTINVVDV | 1.000 |
| 423 | IQLTKVSAM | 1.000 |
| 267 | VLASDGGLM | 1.000 |
| 704 | SVVIVNLFV | 1.000 |
| 273 | GLMPARAMV | 0.900 |
| 278 | RAMVLVNVT | 0.900 |

TABLE XIX

109P1D4v.1-B7 10-mers
Each peptide is a portion of SEQ ID NO: 3;
each start position is specified, the length
of peptide is 10 amino acids, and the end position
for each peptide is the start position plus nine.

| Pos | Subsequence | Score |
|---|---|---|
| 202 | APVGtSVTQL | 240.000 |
| 773 | VVRCrQAPHL | 200.000 |
| 615 | VPPSnCSYEL | 80.000 |
| 436 | GPNAkINYLL | 80.000 |
| 349 | RPVFsNQFLL | 80.000 |
| 523 | LPRHgTVGLI | 80.000 |
| 138 | MPQLiVQKEL | 80.000 |
| 383 | KPPLnQSAML | 80.000 |
| 166 | FPQRsSTAIL | 80.000 |

TABLE XIX-continued

109P1D4v.1-B7 10-mers
Each peptide is a portion of SEQ ID NO: 3;
each start position is specified, the length
of peptide is 10 amino acids, and the end position
for each peptide is the start position plus nine.

| Pos | Subsequence | Score |
|---|---|---|
| 745 | SPTSdYVKIL | 80.000 |
| 446 | GPDApPEFSL | 36.000 |
| 132 | TPEGdKMPQL | 24.000 |
| 842 | RVTLdLPIDL | 20.000 |
| 307 | TVVLsENIPL | 20.000 |
| 7 | LPID1EEQTM | 20.000 |
| 5 | LVYKtGDVPL | 20.000 |
| 481 | LAKDnGVPPL | 12.000 |
| 53 | AILPdEIFRL | 12.000 |
| 377 | LAADaGKPPL | 12.000 |
| 459 | TGMLtVVKKL | 12.000 |

TABLE XX

109P1D4v.1-B3501-9-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 40 | IPRDEHCFY | 360.000 |
| 383 | KPPLNQSAM | 80.000 |
| 523 | LPRHGTVGL | 60.000 |
| 817 | SPKNLLLNF | 60.000 |
| 796 | TPNPENRQM | 60.000 |
| 507 | SPVFTHNEY | 40.000 |
| 349 | RPVFSNQFL | 40.000 |
| 302 | NPVNDTVVL | 30.000 |
| 871 | DSPDLARHY | 20.000 |
| 314 | IPLNTKIAL | 20.000 |
| 260 | TPNHKLLVL | 20.000 |
| 453 | FSLDCRTGM | 20.000 |
| 436 | GPNAKINYL | 20.000 |
| 344 | IPFRLRPVF | 20.000 |
| 28 | GARIDREKL | 13.500 |
| 745 | SPTSDYVKI | 12.000 |
| 798 | NPENRQMIM | 12.000 |
| 292 | VPSIDIRYI | 12.000 |
| 639 | IAVDNDTGM | 12.000 |

TABLE XX-continued

109P1D4v.1-B3501-9-mers
Each peptide is a portion of SEQ ID NO: 3;
each start position is specified, the length
of peptide is 9 amino acids, and the end position
for each peptide is the start position plus eight.

| Pos | Subsequence | Score |
|-----|-------------|-------|
| 880 | KSASPQPAF | 10.000 |
| 921 | CSSSSSDPY | 10.000 |
| 158 | KVKVEDGGF | 9.000 |
| 894 | TPLNSKHHI | 8.000 |
| 732 | APVTPNTEI | 8.000 |
| 76  | APLFPATVI | 8.000 |
| 186 | HPVFKETEI | 8.000 |
| 166 | FPQRSSTAI | 8.000 |
| 735 | TPNTEIADV | 6.000 |
| 368 | STKEYAIKL | 6.000 |
| 232 | VSNIARRLF | 5.000 |
| 703 | FSVVIVNLF | 5.000 |
| 542 | NSAVTLSIL | 5.000 |
| 906 | LPLDNTFVA | 4.000 |
| 630 | NPGTVVFQV | 4.000 |
| 626 | LPSTNPGTV | 4.000 |
| 610 | KPVFIVPPS | 4.000 |
| 593 | RSSSAKVTI | 4.000 |
| 420 | SPGIQLTKV | 4.000 |
| 449 | APPEFSLDC | 4.000 |
| 847 | LPIDLEEQT | 4.000 |
| 100 | LPPAVDPDV | 4.000 |
| 950 | RPVGIQVSN | 4.000 |
| 403 | APVFTQSFV | 4.000 |
| 275 | MPARAMVLV | 4.000 |
| 54  | ILPDEIFRL | 3.000 |
| 92  | SAINSKYTL | 3.000 |
| 510 | FTHNEYNFY | 3.000 |
| 591 | VSRSSSAKV | 3.000 |
| 402 | NAPVFTQSF | 3.000 |
| 548 | SILDENDDF | 3.000 |
| 52  | VAILPDEIF | 3.000 |
| 267 | VLASDGGLM | 3.000 |
| 86  | ISIPENSAI | 3.000 |
| 415 | IPENNSPGI | 2.400 |
| 64  | KIRFLIEDI | 2.400 |

TABLE XX-continued

109P1D4v.1-B3501-9-mers
Each peptide is a portion of SEQ ID NO: 3;
each start position is specified, the length
of peptide is 9 amino acids, and the end position
for each peptide is the start position plus eight.

| Pos | Subsequence | Score |
|-----|-------------|-------|
| 55  | LPDEIFRLV | 2.400 |
| 102 | AAVDPDVGI | 2.400 |
| 291 | NVPSIDIRY | 2.000 |
| 223 | KIHFSFSNL | 2.000 |
| 742 | DVSSPTSDY | 2.000 |
| 71  | DINDNAPLF | 2.000 |
| 356 | FLLETAAYL | 2.000 |
| 843 | VTLDLPIDL | 2.000 |
| 487 | VPPLTSNVT | 2.000 |
| 614 | IVPPSNCSY | 2.000 |
| 435 | SGPNAKINY | 2.000 |
| 272 | GGLMPARAM | 2.000 |
| 882 | ASPQPAFQI | 2.000 |
| 616 | PPSNCSYEL | 2.000 |
| 714 | ESVTNATLI | 2.000 |
| 169 | RSSTAILQV | 2.000 |
| 384 | PPLNQSAML | 2.000 |
| 502 | DQNDNSPVF | 2.000 |
| 531 | LITVTDPDY | 2.000 |
| 423 | IQLTKVSAM | 2.000 |
| 645 | TGMNAEVRY | 2.000 |
| 605 | DVNDNKPVF | 2.000 |
| 445 | LGPDAPPEF | 2.000 |
| 864 | TPTTFKPDS | 2.000 |
| 688 | RVLVKANDL | 2.000 |
| 79  | FPATVINIS | 2.000 |
| 108 | VGINGVQNY | 2.000 |
| 181 | DTNDNHPVF | 2.000 |
| 90  | ENSAINSKY | 2.000 |
| 147 | LDREEKDTY | 1.800 |
| 470 | REKEDKYLF | 1.800 |
| 395 | KVKDENDNA | 1.800 |
| 596 | SAKVTINVV | 1.800 |
| 837 | DSDGNRVTL | 1.500 |
| 95  | NSKYTLPAA | 1.500 |
| 923 | SSSSDPYSV | 1.500 |

TABLE XX-continued

109P1D4v.1-B3501-9-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 308 | VVLSENIPL | 1.500 |
| 918 | ISKCSSSSS | 1.500 |
| 39 | GIPRDEHCF | 1.500 |
| 196 | VSIPENAPV | 1.500 |
| 571 | FDREKQESY | 1.200 |
| 468 | LDREKEDKY | 1.200 |
| 698 | QPDSLFSVV | 1.200 |
| 243 | NATTGLITI | 1.200 |
| 105 | DPDVGINGV | 1.200 |

TABLE XXI

109P1D4v.1-B3501-10-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 847 | LPIDlEEQTM | 120.000 |
| 383 | KPPLnQSAML | 40.000 |
| 927 | DPYSvSDCGY | 40.000 |
| 349 | RPVFsNQFLL | 40.000 |
| 523 | LPRHgTVGLI | 24.000 |
| 436 | GPNAkINYLL | 20.000 |
| 138 | MPQLiVQKEL | 20.000 |
| 202 | APVGtSVTQL | 20.000 |
| 745 | SPTSdYVKIL | 20.000 |
| 166 | FPQRsSTAIL | 20.000 |
| 615 | VPPSnCSYEL | 20.000 |
| 481 | LAKDnGVPPL | 18.000 |
| 897 | NSKHhIIQEL | 15.000 |
| 798 | NPENrQMIMM | 12.000 |
| 817 | SPKNlLLNFV | 12.000 |
| 453 | FSLDcRTGML | 10.000 |
| 434 | DSGPnAKINY | 10.000 |
| 506 | NSPVfTHNEY | 10.000 |
| 796 | TPNPeNRQMI | 8.000 |
| 79 | FPATvINISI | 8.000 |

TABLE XXI-continued

109P1D4v.1-B3501-10-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 314 | IPLNtKIALI | 8.000 |
| 630 | NPGTvVFQVI | 8.000 |
| 894 | TPLNsKHHII | 8.000 |
| 547 | LSILdENDDF | 7.500 |
| 368 | STKEyAIKLL | 6.000 |
| 446 | GPDApPEFSL | 6.000 |
| 377 | LAADaGKPPL | 6.000 |
| 347 | RLRPvFSNQF | 6.000 |
| 132 | TPEGdKMPQL | 6.000 |
| 253 | EPLDrEETPN | 6.000 |
| 816 | HSPKnLLLNF | 5.000 |
| 91 | NSAInSKYTL | 5.000 |
| 367 | ESTKeYAIKL | 5.000 |
| 936 | YPVTtFEVPV | 4.000 |
| 292 | VPSIdIRYIV | 4.000 |
| 920 | KCSSsSSDPY | 4.000 |
| 943 | VPVSvHTRPV | 4.000 |
| 610 | KPVFiVPPSN | 4.000 |
| 950 | RPVGiQVSNT | 4.000 |
| 487 | VPPLtSNVTV | 4.000 |
| 626 | LPSTnPGTVV | 4.000 |
| 906 | LPLDnTFVAC | 4.000 |
| 664 | FAIDqETGNI | 3.000 |
| 744 | SSPTsDYVKI | 3.000 |
| 354 | NQFLlETAAY | 3.000 |
| 118 | LIKSqNIFGL | 3.000 |
| 266 | LVLAsDGGLM | 3.000 |
| 773 | VVRCrQAPHL | 3.000 |
| 39 | GIPRdEHCFY | 3.000 |
| 95 | NSKYtLPAAV | 3.000 |
| 795 | ATPNpENRQM | 3.000 |
| 698 | QPDSlFSVVI | 2.400 |
| 885 | QPAFqIQPET | 2.000 |
| 226 | FSFSnLVSNI | 2.000 |
| 842 | RVTLdLPIDL | 2.000 |
| 638 | VIAVdNDTGM | 2.000 |

TABLE XXI-continued

109P1D4v.1-B3501-10-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 120 | KSQNiFGLDV | 2.000 |
| 12 | VPLIrIEEDT | 2.000 |
| 613 | FIVPpSNCSY | 2.000 |
| 76 | APLFpATVIN | 2.000 |
| 420 | SPGIqLTKVS | 2.000 |
| 384 | PPLNqSAMLF | 2.000 |
| 945 | VSVHtRPVGI | 2.000 |
| 530 | GLITvTDPDY | 2.000 |
| 290 | DNVPsIDIRY | 2.000 |
| 507 | SPVFtHNEYN | 2.000 |
| 422 | GIQLtKVSAM | 2.000 |
| 344 | IPFRlRPVFS | 2.000 |
| 275 | MPARaMVLVN | 2.000 |
| 728 | KSTEaPVTPN | 2.000 |
| 302 | NPVNdTVVLS | 2.000 |
| 644 | DTGMnAEVRY | 2.000 |
| 217 | DIGEnAKIHF | 2.000 |
| 107 | DVGInGVQNY | 2.000 |
| 779 | APHLkAAQKN | 2.000 |
| 260 | TPNHkLLVLA | 2.000 |
| 735 | TPNTeIADVS | 2.000 |
| 271 | DGGLmPARAM | 2.000 |
| 491 | TSNVtVFVSI | 2.000 |
| 403 | APVFtQSFVT | 2.000 |
| 488 | PPLTsNVTVF | 2.000 |
| 732 | APVTpNTEIA | 2.000 |
| 536 | DPDYgDNSAV | 1.800 |
| 8 | KTGDvPLIRI | 1.600 |
| 569 | ISFDrEKQES | 1.500 |
| 53 | AILPdEIFRL | 1.500 |
| 307 | TVVLsENIPL | 1.500 |
| 785 | AQKNkQNSEW | 1.500 |
| 922 | SSSSsDPYSV | 1.500 |
| 301 | VNPVnDTVVL | 1.500 |
| 591 | VSRSsSAKVT | 1.500 |
| 38 | AGIPrDEHCF | 1.500 |

TABLE XXI-continued

109P1D4v.1-B3501-10-mers
Each peptide is a portion of SEQ ID NO: 3;
each start position is specified, the length
of peptide is 9 amino acids, and the end position
for each peptide is the start position plus eight.

| Pos | Subsequence | Score |
|---|---|---|
| 27 | TGARiDREKL | 1.500 |
| 866 | TTFKpDSPDL | 1.500 |
| 840 | GNRVtLDLPI | 1.200 |
| 40 | IPRDeHCFYE | 1.200 |
| 692 | KANDlGQPDS | 1.200 |
| 16 | RIEEdTGEIF | 1.200 |
| 467 | KLDReKEDKY | 1.200 |
| 573 | REKQeSYTFY | 1.200 |

TABLE IX

109P1D4v.1—A1-10-mers
Each peptide is a portion of SEQ ID NO: 3;
each start position is specified, the length
of peptide is 10 amino acids, and the end position
for each peptide is the start position plus nine.

| Pos | Subsequence | Score |
|---|---|---|
| 357 | LLETaAYLDY | 225.000 |
| 850 | DLEEqTMGKY | 45.000 |
| 434 | DSGPnAKINY | 37.500 |
| 310 | LSENiPLNTK | 27.000 |
| 363 | YLDYeSTKEY | 25.000 |
| 103 | AVDPdVGING | 25.000 |
| 160 | KVEDgGFPQR | 18.000 |
| 584 | KAEDgGRVSR | 18.000 |
| 269 | ASDGgLMPAR | 15.000 |
| 55 | LPDEiFRLVK | 12.500 |
| 534 | VTDPdYGDNS | 12.500 |
| 557 | TIDSqTGVIR | 10.000 |
| 16 | RIEEdTGEIF | 9.000 |
| 925 | SSDPySVSDC | 7.500 |
| 339 | FTDHeIPFRL | 6.250 |
| 290 | DNVPsIDIRY | 6.250 |
| 743 | VSSPtSDYVK | 6.000 |
| 575 | KQESyTFYVK | 5.400 |
| 613 | FIVPpSNCSY | 5.000 |
| 729 | STEApVTPNT | 4.500 |
| 648 | NAEVrYSIVG | 4.500 |
| 88 | IPENsAINSK | 4.500 |

TABLE IX-continued

109P1D4v.1—A1-10-mers
Each peptide is a portion of SEQ ID NO: 3;
each start position is specified, the length
of peptide is 10 amino acids, and the end position
for each peptide is the start position plus nine.

| Pos | Subsequence | Score |
|---|---|---|
| 747 | TSDYvKILVA | 3.750 |
| 418 | NNSPgIQLTK | 2.500 |
| 146 | ELDReEKDTY | 2.500 |
| 644 | DTGMnAEVRY | 2.500 |
| 549 | ILDEnDDFTI | 2.500 |
| 454 | SLDCrTGMLT | 2.500 |
| 285 | VTDVnDNVPS | 2.500 |
| 467 | KLDReKEDKY | 2.500 |
| 640 | AVDNdTGMNA | 2.500 |
| 669 | ETGNiTLMEK | 2.500 |
| 21 | TGEIfTTGAR | 2.250 |
| 444 | LLGPdAPPEF | 2.000 |
| 931 | VSDCgYPVTT | 1.500 |
| 903 | IQELpLDNTF | 1.350 |
| 213 | ATDAdIGENA | 1.250 |
| 179 | VTDTnDNHPV | 1.250 |
| 681 | VTDLgLHRVL | 1.250 |
| 798 | NPENrQMIMM | 1.125 |
| 191 | ETEIeVSIPE | 1.125 |
| 181 | DTNDnHPVFK | 1.000 |
| 378 | AADAgKPPLN | 1.000 |
| 432 | DADSgPNAKI | 1.000 |
| 215 | DADIgENAKI | 1.000 |
| 126 | GLDViETPEG | 1.000 |
| 683 | DLGLhRVLVK | 1.000 |
| 458 | RTGMlTVVKK | 1.000 |
| 719 | ATLInELVRK | 1.000 |
| 530 | GLITvTDPDY | 1.000 |
| 329 | DADHnGRVTC | 1.000 |
| 397 | KDENdNAPVF | 0.900 |
| 827 | TIEEtKADDV | 0.900 |
| 129 | VIETpEGDKM | 0.900 |
| 193 | EIEVsIPENA | 0.900 |
| 506 | NSPVfTHNEY | 0.750 |
| 228 | FSNLvSNIAR | 0.750 |
| 288 | VNDNvPSIDI | 0.625 |

TABLE IX-continued

109P1D4v.1—A1-10-mers
Each peptide is a portion of SEQ ID NO: 3;
each start position is specified, the length
of peptide is 10 amino acids, and the end position
for each peptide is the start position plus nine.

| Pos | Subsequence | Score |
|---|---|---|
| 606 | VNDNkPVFIV | 0.625 |
| 399 | ENDNaPVFTQ | 0.625 |
| 72 | INDNaPLFPA | 0.625 |
| 503 | QNDNsPVFTH | 0.625 |
| 446 | GPDApPEFSL | 0.625 |
| 914 | ACDSiSKCSS | 0.500 |
| 678 | KCDVtDLGLH | 0.500 |
| 718 | NATLiNELVR | 0.500 |
| 217 | DIGEnAKIHF | 0.500 |
| 53 | AILPdEIFRL | 0.500 |
| 628 | STNPgTVVFQ | 0.500 |
| 248 | LITIkEPLDR | 0.500 |
| 151 | EKDTyVMKVK | 0.500 |
| 430 | AMDAdSGPNA | 0.500 |
| 832 | KADDvDSDGN | 0.500 |
| 273 | GLMPaRAMVL | 0.500 |
| 889 | QIQPeTPLNS | 0.500 |
| 564 | VIRPnISFDR | 0.500 |
| 461 | MLTVvKKLDR | 0.500 |
| 337 | TCFTdHEIPF | 0.500 |
| 500 | IIDQnDNSPV | 0.500 |
| 448 | DAPPeFSLDC | 0.500 |
| 140 | QLIVqKELDR | 0.500 |
| 107 | DVGInGVQNY | 0.500 |
| 52 | VAILpDEIFR | 0.500 |
| 760 | GTITvVVVIF | 0.500 |
| 920 | KCSSsSSDPY | 0.500 |
| 881 | SASPqPAFQI | 0.500 |
| 603 | VVDVnDNKPV | 0.500 |
| 26 | TTGArIDREK | 0.500 |
| 835 | DVDSdGNRVT | 0.500 |
| 665 | AIDQeTGNIT | 0.500 |
| 132 | TPEGdKMPQL | 0.450 |
| 251 | IKEPIDREET | 0.450 |
| 712 | VNESvTNATL | 0.450 |
| 778 | QAPHlKAAQK | 0.400 |

TABLE IX-continued

109P1D4v.1—A1-10-mers
Each peptide is a portion of SEQ ID NO: 3; each start position is specified, the length of peptide is 10 amino acids, and the end position for each peptide is the start position plus nine.

| Pos | Subsequence | Score |
|---|---|---|
| 196 | VSIPeNAPVG | 0.300 |
| 388 | QSAM1FIKVK | 0.300 |
| 871 | DSPD1ARHYK | 0.300 |
| 86 | ISIPeNSAIN | 0.300 |
| 872 | SPDLaRHYKS | 0.250 |
| 833 | ADDVdSDGNR | 0.250 |

TABLE VIII

109P1D4v.2-C' Terminal-A1-9-mers
Each peptide is a portion of SEQ ID NO: 5; each start position is specified, the length of peptide is 9 amino acids, and the end position for each peptide is the start position plus eight.

| Pos | Subsequence | Score |
|---|---|---|
| 12 | RTSTIEICS | 0.125 |
| 8 | PTDSRTSTI | 0.125 |
| 14 | STIEIOSEI | 0.025 |
| 5 | HTRPTDSRT | 0.025 |
| 3 | SVHTRPTDS | 0.010 |
| 10 | DSRTSTIEI | 0.008 |
| 2 | VSVHTRPTD | 0.003 |
| 7 | RPTDSRTST | 0.003 |
| 13 | TSTIEICSE | 0.002 |
| 1 | PVSVHTRPT | 0.001 |
| 4 | VHTRPTDSR | 0.001 |
| 11 | SRTSTIEIC | 0.001 |
| 6 | TRPTDSRTS | 0.001 |
| 9 | TDSRTSTIE | 0.000 |

TABLE VIII

109P1D4v.2-N' terminal-A1-9-mers
Each peptide is a portion of SEQ ID NO: 5; each start position is specified, the length of peptide is 9 amino acids, and the end position for each peptide is the start position plus eight.

| Pos | Subsequence | Score |
|---|---|---|
| 29 | GMDLLSGTY | 12.500 |
| 2 | RTERQWVLI | 0.450 |
| 25 | TSVPGMDLL | 0.150 |
| 24 | VTSVPGMDL | 0.125 |
| 26 | SVPGMDLLS | 0.050 |
| 14 | QVLCGLIQQ | 0.050 |
| 22 | QTVTSVPGM | 0.050 |
| 7 | WVLIQIFQV | 0.050 |
| 18 | GLIQQTVTS | 0.020 |
| 9 | LIQIFQVLC | 0.020 |
| 27 | VPGMDLLSG | 0.013 |
| 19 | LIQQTVTSV | 0.010 |
| 8 | VLIQIFQVL | 0.010 |
| 11 | QIFQVLCGL | 0.010 |
| 15 | VLCGLIQQT | 0.010 |
| 16 | LCGLIQQTV | 0.010 |
| 10 | IQIFQVLCG | 0.007 |
| 13 | FQVLCGLIQ | 0.007 |
| 21 | QQTVTSVPG | 0.003 |
| 6 | QWVLIQIFQ | 0.003 |
| 4 | ERQWVLIQI | 0.003 |
| 17 | CGLIQQTVT | 0.003 |
| 5 | RQWVLIQIF | 0.002 |
| 23 | TVTSVPGMD | 0.001 |
| 1 | MRTERQWVL | 0.001 |
| 12 | IFQVLCGLI | 0.001 |
| 3 | TERQWVLIQ | 0.000 |
| 28 | PGMDLLSGT | 0.000 |
| 20 | IQQTVTSVP | 0.000 |

TABLE VIII

109P1D4v.3
A1-9-mers
Each peptide is a portion of SEQ ID NO: 7; each start position is specified, the length of peptide is 9 amino acids, and the end position for each peptide is the start position plus eight.

| Pos | Subsequence | Score |
|---|---|---|
| 37 | KSEGKVAGK | 54.000 |
| 106 | NSDPESTFI | 7.500 |
| 78 | TSHGLPLGY | 3.750 |
| 145 | HSDACWMPA | 3.750 |
| 111 | STFIPGLKK | 2.500 |
| 135 | NCTQECLIY | 2.500 |
| 234 | SAQASALCY | 2.500 |
| 29 | WIHPQPQRK | 2.000 |
| 108 | DPESTFIPG | 1.125 |
| 128 | TVEEASDNC | 0.900 |
| 120 | AAEITVQPT | 0.900 |
| 132 | ASDNCTQEC | 0.750 |
| 62 | SSDGGLGDH | 0.750 |
| 288 | SVDQGVQGS | 0.500 |
| 154 | SLDHSSSSQ | 0.500 |
| 25 | TMEIWIHPQ | 0.450 |
| 3 | SVHTRPPMK | 0.400 |
| 110 | ESTFIPGLK | 0.300 |
| 137 | TQECLIYGH | 0.270 |
| 84 | LGYPQEEYF | 0.250 |
| 20 | MKESTTMEI | 0.225 |
| 54 | LPEGSQESS | 0.225 |
| 100 | RTEGDGNSD | 0.225 |
| 254 | HSSPLPQVI | 0.150 |
| 230 | HSPPSAQAS | 0.150 |
| 218 | HSPPLVQAT | 0.150 |
| 177 | ASTQHHSPR | 0.150 |
| 194 | HSPPVTQTI | 0.150 |
| 206 | HSPPPIQVS | 0.150 |
| 170 | HSPPLSQAS | 0.150 |
| 242 | YSPPLAQPA | 0.150 |
| 58 | SQESSSDGG | 0.135 |
| 186 | VTQTIALCH | 0.125 |
| 136 | CTQECLIYG | 0.125 |
| 67 | LGDHDAGSL | 0.125 |
| 294 | QGSATSQFY | 0.125 |
| 256 | SPLPQVIAL | 0.125 |
| 86 | YPQEEYFDR | 0.125 |
| 69 | DHDAGSLTS | 0.125 |
| 198 | VTQTIALCH | 0.125 |
| 258 | LPQVIALHR | 0.125 |
| 333 | RGDSPMEEH | 0.125 |
| 16 | SCTPMKEST | 0.100 |
| 316 | KVIPLTTFT | 0.100 |
| 307 | RLHPSDDSI | 0.100 |
| 124 | TVQPTVEEA | 0.100 |
| 41 | KVAGKSQRR | 0.100 |
| 310 | PSDDSIKVI | 0.075 |
| 76 | TSTSHGLPL | 0.075 |
| 22 | ESTTMEIWI | 0.075 |
| 295 | GSATSQFYT | 0.075 |
| 252 | ISHSSPLPQ | 0.075 |
| 222 | LVQATALHH | 0.050 |
| 77 | STSHGLPLG | 0.050 |
| 240 | LCYSPPLAQ | 0.050 |
| 168 | LCHSPPLSQ | 0.050 |
| 7 | RPPMKEVVR | 0.050 |
| 80 | HGLPLGYPQ | 0.050 |
| 178 | STQHHSPRV | 0.050 |
| 246 | LAQAAAISH | 0.050 |
| 162 | QAQASALCH | 0.050 |
| 322 | TFTPRQQAR | 0.050 |
| 83 | PLGYPQEEY | 0.050 |
| 282 | GADGLCSVD | 0.050 |
| 207 | SPPPIQVSA | 0.050 |
| 10 | MKEVVRSCT | 0.045 |
| 88 | QEEYFDRAT | 0.045 |
| 129 | VEEASDNCT | 0.045 |
| 13 | VVRSCTPMK | 0.040 |

TABLE VIII-continued

109P1D4v.3
A1-9-mers
Each peptide is a portion of SEQ ID NO: 7; each start position is specified, the length of peptide is 9 amino acids, and the end position for each peptide is the start position plus eight.

| Pos | Subsequence | Score |
| --- | --- | --- |
| 287 | CSVDQGVQG | 0.030 |
| 157 | HSSSSQAQA | 0.030 |
| 255 | SSPLPQVIA | 0.030 |
| 159 | SSSQAQASA | 0.030 |
| 2 | VSVHTRPPM | 0.030 |
| 304 | MSERLHPSD | 0.027 |
| 318 | IPLTTFTPR | 0.025 |
| 297 | ATSQFYTMS | 0.025 |
| 149 | CWMPASLDH | 0.025 |
| 5 | HTRPPMKEV | 0.025 |
| 105 | GNSDPESTF | 0.025 |
| 95 | ATPSNRTEG | 0.025 |
| 205 | CHSPPPIQV | 0.025 |
| 23 | STTMEIWIH | 0.025 |
| 17 | CTPMKESTT | 0.025 |
| 320 | LTTFTPRQQ | 0.025 |
| 321 | TTFTPRQQA | 0.025 |
| 50 | VTFHLPEGS | 0.025 |
| 215 | ALHHSPPLV | 0.020 |
| 167 | ALCHSPPLS | 0.020 |
| 214 | SALHHSPPL | 0.020 |
| 190 | IALCHSPPV | 0.020 |
| 238 | SALCYSPPL | 0.020 |
| 49 | RVTFHLPEG | 0.020 |
| 226 | TALHHSPPS | 0.020 |
| 274 | SLQQGWVQG | 0.020 |
| 192 | LCHSPPVTQ | 0.020 |
| 204 | LCHSPPPIQ | 0.020 |
| 66 | GLGDHDAGS | 0.020 |
| 185 | RVTQTIALC | 0.020 |
| 147 | DACWMPASL | 0.020 |

TABLE VIII

109P1D4v.4
A1-9-mers
Each peptide is a portion of SEQ ID NO: 9; each start position is specified, the length of peptide is 9 amino acids, and the end position for each peptide is the start position plus eight.

| Pos | Subsequence | Score |
| --- | --- | --- |
| 4 | HPQPQSQRR | 0.250 |
| 2 | WIHPQPQSQ | 0.100 |
| 3 | IHPQPOSQR | 0.005 |
| 7 | PQSQRRVTF | 0.003 |
| 6 | QPQSQRRVT | 0.003 |
| 8 | QSQRRVTFH | 0.002 |
| 1 | IWIHPQPQS | 0.001 |
| 5 | PQPQSQRRV | 0.000 |

TABLE IX

109P1D4v.4
A1-10-mers
Each peptide is a portion of SEQ ID NO: 9; each start position is specified, the length of peptide is 10 amino acids, and the end position for each peptide is the start position plus nine.

| Pos | Subsequence | Score |
| --- | --- | --- |
| 3 | WIHPqPQSQR | 1.000 |
| 7 | QPQSqRRVTF | 0.050 |
| 5 | HPQPqSQRRV | 0.025 |
| 9 | QSQRrVTFHL | 0.008 |
| 4 | IHPQpQSQRR | 0.005 |
| 1 | EIWIhPQPQS | 0.002 |
| 2 | IWIHpQPQSQ | 0.001 |
| 6 | PQPQsQRRVT | 0.000 |
| 8 | PQSQrRVTFH | 0.000 |

TABLE X

109P1D4v.4
A0201-9-mers
Each peptide is a portion of SEQ ID NO: 9; each start position is specified, the length of peptide is 9 amino acids, and the end position for each peptide is the start position plus eight.

| Pos | Subsequence | Score |
| --- | --- | --- |
| 5 | PQPQSQRRV | 0.031 |
| 2 | WIHPQPQSQ | 0.009 |

TABLE X-continued

109P1D4v.4
A0201-9-mers
Each peptide is a portion of SEQ ID NO: 9; each start position is specified, the length of peptide is 9 amino acids, and the end position for each peptide is the start position plus eight.

| Pos | Subsequence | Score |
|---|---|---|
| 8 | QSQRRVTFH | 0.006 |
| 6 | QPQSQRRVT | 0.004 |
| 7 | PQSQRRVTF | 0.000 |
| 3 | IHPQPQSQR | 0.000 |
| 1 | IWIHPQPQS | 0.000 |
| 4 | HPQPQSQRR | 0.000 |

TABLE IX

109P1D4v.4
A0201-10-mers
Each peptide is a portion of SEQ ID NO: 9; each start position is specified, the length of peptide is 10 amino acids, and the end position for each peptide is the start position plus nine.

| Pos | Subsequence | Score |
|---|---|---|
| 9 | QSQRrVTFHL | 0.809 |
| 3 | WIHPqPQSQR | 0.009 |
| 1 | EIWIhPQPQS | 0.006 |
| 5 | HPQPqSQRRV | 0.003 |
| 8 | PQSQrRVTFH | 0.002 |
| 6 | PQPQsQRRVT | 0.001 |
| 7 | QPQSqRRVTF | 0.000 |
| 4 | IHPQpQSQRR | 0.000 |
| 2 | IWIHpQPQSQ | 0.000 |

TABLE XII

109P1D4v.4
A3-9-mers
Each peptide is a portion of SEQ ID NO: 9; each start position is specified, the length of peptide is 9 amino acids, and the end position for each peptide is the start position plus eight.

| Pos | Subsequence | Score |
|---|---|---|
| 4 | HPQPQSQRR | 0.060 |
| 3 | IHPQPQSQR | 0.006 |
| 7 | PQSQRRVTF | 0.006 |
| 2 | WIHPQPQSQ | 0.003 |

TABLE XII-continued

109P1D4v.4
A3-9-mers
Each peptide is a portion of SEQ ID NO: 9; each start position is specified, the length of peptide is 9 amino acids, and the end position for each peptide is the start position plus eight.

| Pos | Subsequence | Score |
|---|---|---|
| 8 | QSQRRVTFH | 0.003 |
| 6 | QPQSQRRVT | 0.000 |
| 1 | IWIHPQPQS | 0.000 |
| 5 | PQPQSQRRV | 0.000 |

TABLE XIII

109P1D4v.4
A3-10-mers
Each peptide is a portion of SEQ ID NO: 9; each start position is specified, the length of peptide is 10 amino acids, and the end position for each peptide is the start position plus nine.

| Pos | Subsequence | Score |
|---|---|---|
| 3 | WIHPqPQSQR | 0.900 |
| 7 | QPQSqRRVTF | 0.020 |
| 9 | QSQRrVTFHL | 0.013 |
| 1 | EIWIhPQPQS | 0.009 |
| 4 | IHPQpQSQRR | 0.004 |
| 8 | PQSQrRVTFH | 0.002 |
| 5 | HPQPqSQRRV | 0.000 |
| 6 | PQPQsQRRVT | 0.000 |
| 2 | IWIHpQPQSQ | 0.000 |

TABLE XIV

109P1D4v.4
A1101-9-mers
Each peptide is a portion of SEQ ID NO: 9; each start position is specified, the length of peptide is 9 amino acids, and the end position for each peptide is the start position plus eight.

| Pos | Subsequence | Score |
|---|---|---|
| 4 | HPQPQSQRR | 0.060 |
| 3 | IHPQPQSQR | 0.006 |
| 7 | PQSQRRVTF | 0.006 |
| 2 | WIHPQPQSQ | 0.003 |
| 8 | QSQRRVTFH | 0.003 |
| 5 | QPQSQRRVT | 0.000 |

TABLE XIV-continued

109P1D4v.4
A1101-9-mers
Each peptide is a portion of SEQ
ID NO: 9; each start position is
specified, the length of peptide is
9 amino acids, and the end position
for each peptide is the start
position plus eight.

| Pos | Subsequence | Score |
|---|---|---|
| 1 | IWIHPQPQS | 0.000 |
| 6 | PQPQSQRRV | 0.000 |

TABLE XV

109P1D4v.4
A1101-10-mers
Each peptide is a portion of SEQ
ID NO: 9; each start position is
specified, the length of peptide is
10 amino acids, and the end
position for each peptide is the
start position plus nine.

| Pos | Subsequence | Score |
|---|---|---|
| 3 | WIHPqPQSQR | 0.080 |
| 4 | IHPQpQSQRR | 0.004 |
| 7 | QPQSqRRVTF | 0.002 |
| 8 | PQSQrRVTFH | 0.001 |
| 9 | QSQRrVTFHL | 0.001 |
| 1 | EIWIhPQPQS | 0.000 |
| 5 | HPQPqSQRRV | 0.000 |
| 2 | IWIHpPQPSQ | 0.000 |
| 6 | PQPQsQRRVT | 0.000 |

TABLE XVI

109P1D4v.4
A24-9-mers
Each peptide is a portion of SEQ
ID NO: 9; each start position is
specified, the length of peptide is 9
amino acids, and the end position
for each peptide is the start
position plus eight.

| Pos | Subsequence | Score |
|---|---|---|
| 7 | PQSQRRVTF | 0.200 |
| 6 | QPQSQRRVT | 0.150 |
| 1 | IWIHPQPQS | 0.150 |
| 4 | HPQPQSQRR | 0.022 |
| 8 | QSQRRVTFH | 0.015 |
| 5 | PQPQSQRRV | 0.015 |
| 2 | WIHPQPQSQ | 0.014 |
| 3 | IHPQPQSQR | 0.002 |

TABLE XVII

109P1D4v.4
A24-100-mers
Each peptide is a portion of SEQ
ID NO: 9; each start position is
specified, the length of peptide is
10 amino acids, and the end
position for each peptide is the
start position plus nine.

| Pos | Subsequence | Score |
|---|---|---|
| 9 | QSQRrVTFHL | 8.400 |
| 7 | QPQSqRRVTF | 3.000 |
| 5 | HPQPqSQRRV | 0.180 |
| 1 | EIWIhPQPQS | 0.100 |
| 2 | IWIHpPQPSQ | 0.018 |
| 6 | PQPQSQRRVT | 0.015 |
| 3 | WIHPqPQSQR | 0.012 |
| 4 | IHPQpQSQRR | 0.002 |
| 8 | PQSQrRVTFH | 0.001 |

TABLE XVIII

109P1D4v.4
B7-9-mers
Each peptide is a portion of SEQ
ID NO: 9; each start position is
specified, the length of peptide is 9
amino acids, and the end position
for each peptide is the start
position plus eight.

| Pos | Subsequence | Score |
|---|---|---|
| 6 | QPQSQRRVT | 3.000 |
| 4 | HPQPQSQRR | 0.200 |
| 5 | PQPQSQRRV | 0.020 |
| 8 | QSQRRVTFH | 0.010 |
| 2 | WIHPQPQSQ | 0.010 |
| 7 | PQSQRRVTF | 0.003 |
| 1 | IWIHPQPQS | 0.003 |
| 3 | IHPQPQSQR | 0.002 |

TABLE XIX

109P1D4v.4
B7-10-mers
Each peptide is a portion of SEQ
ID NO: 9; each start position is
specified, the length of peptide is
10 amino acids, and the end
position for each peptide is the
start position plus nine.

| Pos | Subsequence | Score |
|---|---|---|
| 9 | QSQRrVTFHL | 4.000 |
| 5 | HPQPqSQRRV | 4.000 |

TABLE XIX-continued

109P1D4v.4
B7-10-mers
Each peptide is a portion of SEQ
ID NO: 9; each start position is
specified, the length of peptide is
10 amino acids, and the end
position for each peptide is the
start position plus nine.

| Pos | Subsequence | Score |
|---|---|---|
| 7 | QPQSqRRVTF | 0.600 |
| 1 | EIWIhPQPQS | 0.030 |
| 3 | WIHPqPQSQR | 0.015 |
| 6 | PQPQsQRRVT | 0.015 |
| 8 | PQSQrRVTFH | 0.001 |
| 2 | IWIHpPQPQSQ | 0.001 |
| 4 | IHPQpQSQRR | 0.001 |

TABLE XX

109P1D4v.4
B3501-9-mers
Each peptide is a portion of SEQ
ID NO: 9; each start position is
specified, the length of peptide is 9
amino acids, and the end position
for each peptide is the start
position plus eight.

| Pos | Subsequence | Score |
|---|---|---|
| 6 | QPQSQRRVT | 2.000 |
| 4 | HPQPQSQRR | 0.200 |
| 7 | PQSQRRVTF | 0.100 |
| 8 | QSQRRVTFH | 0.050 |
| 5 | PQPQSQRRV | 0.020 |
| 1 | IWIHPQPQS | 0.010 |
| 2 | WIHPQPQSQ | 0.010 |
| 3 | IHPQPQSQR | 0.001 |

TABLE XIX

109P1D4v.4
B3501-10-mers
Each peptide is a portion of SEQ
ID NO: 9; each start position is
specified, the length of peptide is
9 amino acids, and the end
position for each peptide is the
start position plus eight.

| Pos | Subsequence | Score |
|---|---|---|
| 7 | QPQSqRRVTF | 20.000 |
| 9 | QSQRrVTFHL | 5.000 |
| 5 | HPQPqSQRRV | 4.000 |
| 1 | EIWIhPQPQS | 0.100 |

TABLE XIX-continued

109P1D4v.4
B3501-10-mers
Each peptide is a portion of SEQ
ID NO: 9; each start position is
specified, the length of peptide is
9 amino acids, and the end
position for each peptide is the
start position plus eight.

| Pos | Subsequence | Score |
|---|---|---|
| 6 | PQPQsQRRVT | 0.010 |
| 3 | WIHPqPQSQR | 0.010 |
| 8 | PQSQrRVTFH | 0.001 |
| 2 | IWIHpPQPQSQ | 0.001 |
| 4 | IHPQpQSQRR | 0.001 |

TABLE VIII

109P1D4v.5
A1-9-mers
Each peptide is a portion of SEQ
ID NO: 11; each start position is
specified, the length of peptide is
9 amino acids, and the end
position for each peptide is the
start position plus eight.

| Pos | Subsequence | Score |
|---|---|---|
| 3 | SVHTRPSQR | 0.100 |
| 7 | RPSQRRVTF | 0.050 |
| 2 | VSVHTRPSQ | 0.030 |
| 5 | HTRPSQRRV | 0.025 |
| 1 | PVSVHTRPS | 0.001 |
| 4 | VHTRPSQRR | 0.001 |
| 6 | TRPSQRRVT | 0.001 |
| 8 | PSQRRVTFH | 0.000 |

TABLE IX

109P1D4v.5
A1-10-mers
Each peptide is a portion of SEQ
ID NO: 11; each start position is
specified, the length of peptide is
10 amino acids, and the end
position for each pepfide is the
start position plus nine.

| Pos | Subsequence | Score |
|---|---|---|
| 3 | VSVHtRPSQR | 0.150 |
| 4 | SVHTrPSQRR | 0.100 |
| 6 | HTRPsQRRVT | 0.025 |
| 7 | TRPSqRRVTF | 0.010 |
| 1 | VPVSvHTRPS | 0.003 |
| 8 | RPSQrRVTFH | 0.003 |

TABLE IX-continued

109P1D4v.5
A1-10-mers
Each peptide is a portion of SEQ
ID NO: 11; each start position is
specified, the length of peptide is
10 amino acids, and the end
position for each peptide is the
start position plus nine.

| Pos | Subsequence | Score |
|---|---|---|
| 2 | PVSVhTRPSQ | 0.002 |
| 9 | PSQRrVTFHL | 0.001 |
| 5 | VHTRPSQRRV | 0.000 |

TABLE X

109P1O4v.5
A0201-9-mers
Each peptide is a portion of SEQ
ID NO: 11; each start position is
specified, the length of peptide is 9
amino acids, and the end position
for each peptide is the start
position plus eight.

| Pos | Subsequence | Score |
|---|---|---|
| 3 | SVHTRPSQR | 0.001 |
| 5 | HTRPSQRRV | 0.000 |
| 7 | RPSQRRVTF | 0.000 |
| 2 | VSVHTRPSQ | 0.000 |
| 8 | PSQRRVTFH | 0.000 |
| 6 | TRPSQRRVT | 0.000 |
| 1 | PVSVHTRPS | 0.000 |
| 4 | VHTRPSQRR | 0.000 |

TABLE XI

109P1D4v.5
A0201-10-mers
Each peptide is a portion of SEQ
ID NO: 11; each start position is
specified, the length of peptide is
10 amino acids, and the end
position for each peptide is the
start position plus nine.

| Pos | Subsequence | Score |
|---|---|---|
| 9 | PSQRTVTFHL | 0.018 |
| 5 | VHTRpSQRRV | 0.016 |
| 8 | RPSQrRVTFH | 0.006 |
| 4 | SVHTrPSQRR | 0.001 |
| 1 | VPVSvHTRPS | 0.000 |
| 3 | VSVHtRPSQR | 0.000 |
| 2 | PVSVhTRPSQ | 0.000 |

TABLE XI-continued

109P1D4v.5
A0201-10-mers
Each peptide is a portion of SEQ
ID NO: 11; each start position is
specified, the length of peptide is
10 amino acids, and the end
position for each peptide is the
start position plus nine.

| Pos | Subsequence | Score |
|---|---|---|
| 6 | HTRPsQRRVT | 0.000 |
| 7 | TRPSqRRVTF | 0.000 |

TABLE XII

109P1D4v.5
A3-9-mers
Each peptide is a portion of SEQ
ID NO: 11; each start position is
specified, the length of peptide is 9
amino acids, and the end position
for each peptide is the start
position plus eight.

| Pos | Subsequence | Score |
|---|---|---|
| 3 | SVHTRPSQR | 0.400 |
| 7 | RPSQRRVTF | 0.020 |
| 4 | VHTRPSQRR | 0.006 |
| 5 | HTRPSQRRV | 0.002 |
| 8 | PSQRRVTFH | 0.000 |
| 2 | VSVHTRPSQ | 0.000 |
| 1 | PVSVHTRPS | 0.000 |
| 6 | TRPSQRRVT | 0.000 |

TABLE XIV

109P1D4v.5
A1101-9-mers
Each peptide is a portion of SEQ
ID NO: 11; each start position is
specified, the length of peptide is 9
amino acids, and the end position
for each peptide is the start
position plus eight.

| Pos | Subsequence | Score |
|---|---|---|
| 4 | SVHTrPSQRR | 0.600 |
| 3 | VSVHtRPSQR | 0.030 |
| 8 | RPSQrRVTFH | 0.006 |
| 7 | TRPSqRRVTF | 0.002 |
| 9 | PSQRrVTFHL | 0.001 |
| 6 | HTRPsQRRVT | 0.001 |
| 2 | PVSVhTRPSQ | 0.000 |
| 1 | VPVSvHTRPS | 0.000 |
| 5 | VHTRpSQRRV | 0.000 |

TABLE XV

109P1D4v.5
A1101-10-mers
Each peptide is a portion of SEQ
ID NO: 11; each start position is
specified, the length of peptide is
10 amino acids, and the end
position for each peptide is the
start position plus nine.

| Pos | Subsequence | Score |
|---|---|---|
| 4 | SVHTrPSQRR | 0.400 |
| 3 | VSVHtRPSQR | 0.006 |
| 8 | RPSQrRVTFH | 0.006 |
| 7 | TRPSqRRVTF | 0.000 |
| 2 | PVSVhTRPSQ | 0.000 |
| 6 | HTRPsQRRVT | 0.000 |
| 9 | PSQRrVTFHL | 0.000 |
| 1 | VPVSvHTRPS | 0.000 |
| 5 | VHTRpSQRRV | 0.000 |

TABLE XVI

109P1D4v.5
A24-9-mers
Each peptide is a portion of SEQ ID
NO: 11; each start position is
specified, the length of peptide is 9
amino acids, and the end position for
each peptide is the start position plus
eight.

| Pos | Subsequence | Score |
|---|---|---|
| 7 | RPSQRRVTF | 4.000 |
| 5 | HTRPSQRRV | 0.120 |
| 6 | TRPSQRRVT | 0.015 |
| 2 | VSVHTRPSQ | 0.015 |
| 1 | PVSVHTRPS | 0.010 |
| 3 | SVHTRPSQR | 0.010 |
| 8 | PSQRRVTFH | 0.002 |
| 4 | VHTRPSQRR | 0.001 |

TABLE XVII

109P1D4v.5
A24-10-mers
Each peptide is a portion of SEQ
ID NO: 11; each start position is
specified, the length of peptide is
10 amino acids, and the end
position for each peptide is the
start position plus nine.

| Pos | Subsequence | Score |
|---|---|---|
| 9 | PSQRrVTFHL | 0.840 |
| 7 | TRPSqRRVTF | 0.300 |

TABLE XVII-continued

109P1D4v.5
A24-10-mers
Each peptide is a portion of SEQ
ID NO: 11; each start position is
specified, the length of peptide is
10 amino acids, and the end
position for each peptide is the
start position plus nine.

| Pos | Subsequence | Score |
|---|---|---|
| 1 | VPVSvHTRPS | 0.150 |
| 6 | KTRPsQRRVT | 0.120 |
| 8 | RPSQrRVTFH | 0.020 |
| 3 | VSVHtRPSQR | 0.015 |
| 4 | SVHTrPSQRR | 0.012 |
| 5 | VHTRpSQRRV | 0.010 |
| 2 | PVSVhTRPSQ | 0.001 |

TABLE XVIII

109P1D4v.5
B7-9-mers
Each peptide is a portion of SEQ
ID NO: 11; each start position is
specified, the length of peptide is 9
amino acids, and the end position
for each peptide is the start
position plus eight.

| Pos | Subsequence | Score |
|---|---|---|
| 5 | HTRPSQRRV | 2.000 |
| 7 | RPSQRRVTF | 0.600 |
| 3 | SVHTRPSQR | 0.050 |
| 2 | VSVHTRPSQ | 0.015 |
| 6 | TRPSQRRVT | 0.015 |
| 1 | PVSVHTRPS | 0.010 |
| 4 | VHTRPSQRR | 0.002 |
| 8 | PSQRRVTFH | 0.001 |

TABLE XIX

109P1D4v.5
B7-10-mers
Each peptide is a portion of SEQ ID
NO: 11; each start position is
specified, the length of peptide is 10
amino acids, and the end position for
each peptide is the start position plus
nine.

| Pos | Subsequence | Score |
|---|---|---|
| 6 | HTRPsQRRVT | 1.500 |
| 9 | PSQRrVTFHL | 0.400 |
| 1 | VPVSvHTRPS | 0.400 |
| 8 | RPSQrRVTFH | 0.200 |

TABLE XIX-continued

109P1D4v.5
B7-10-mers
Each peptide is a portion of SEQ ID NO: 11; each start position is specified, the length of peptide is 10 amino acids, and the end position for each peptide is the start position plus nine.

| Pos | Subsequence | Score |
|---|---|---|
| 4 | SVHTrPSQRR | 0.075 |
| 5 | VHTRpSQRRV | 0.020 |
| 3 | VSVHtRPSQR | 0.010 |
| 2 | PVSVhTRPSQ | 0.008 |
| 7 | TRPSqRRVTF | 0.003 |

TABLE XX

109P1D4v.5
B3501-9-mers
Each peptide is a portion of SEQ ID NO: 11; each start position is specified, the length of peptide is 9 amino acids, and the end position for each peptide is the start position plus eight.

| Pos | Subsequence | Score |
|---|---|---|
| 7 | RPSQRRVTF | 40.000 |
| 5 | HTRPSQRRV | 0.600 |
| 2 | VSVHTRPSQ | 0.050 |
| 6 | TRPSQRRVT | 0.010 |
| 1 | PVSVHTRPS | 0.010 |
| 3 | SVHTRPSQR | 0.010 |
| 8 | PSQRRVTFH | 0.005 |
| 4 | VHTRPSQRR | 0.001 |

TABLE XXI

109P1D4v.5
B3501-10-mers
Each peptide is a portion of SEQ ID NO: 11; each start position is specified, the length of peptide is 10 amino acids, and the end position for each peptide is the start position plus nine.

| Pos | Subsequence | Score |
|---|---|---|
| 1 | VPVSvHTRPS | 2.000 |
| 9 | PSQRrVTFHL | 0.500 |
| 8 | RPSQrRVTFH | 0.400 |
| 6 | HTRPsQRRVT | 0.300 |
| 7 | TRPSqRRVTF | 0.100 |
| 3 | VSVHtRPSQR | 0.050 |

TABLE XXI-continued

109P1D4v.5
B3501-10-mers
Each peptide is a portion of SEQ ID NO: 11; each start position is specified, the length of peptide is 10 amino acids, and the end position for each peptide is the start position plus nine.

| Pos | Subsequence | Score |
|---|---|---|
| 5 | VHTRpSQRRV | 0.020 |
| 4 | SVHTrPSQRR | 0.010 |
| 2 | PVSVhTRPSQ | 0.001 |

TABLE VIII

109P1D4v.6
C' terminal-A1-9-mers
Each peptide is a portion of SEQ ID NO: 11; each start position is specified, the length of peptide is 9 amino acids, and the end position for each peptide is the start position plus eight.

| Pos | Subsequence | Score |
|---|---|---|
| 5 | HTRPTDSRT | 0.025 |
| 3 | SVHTRPTDS | 0.010 |
| 2 | VSVHTRPTD | 0.003 |
| 1 | PVSVHTRPT | 0.001 |
| 4 | VHTRPTDSR | 0.001 |

TABLE IX

109P1D4v.6
C' terminal-A1-10-mers
Each peptide is a portion of SEQ ID NO: 13; each start position is specified, the length of peptide is 10 amino acids, and the end postion for each pepflde is the start postion plus nine.

| Pos | Subsequence | Score |
|---|---|---|
| 4 | SVHTrPTDSR | 0.100 |
| 3 | VSVHtRPTDS | 0.015 |
| 1 | VPVSvHTRPT | 0.003 |
| 2 | PVSVhTRPTD | 0.000 |
| 5 | VHTRpTDSRT | 0.000 |

TABLE X

109P1D4v.6
C' terminal-A0201-9-mers
Each peptide is a portion of SEQ ID NO: 13; each start position is specified, the length of peptide is 9 amino acids, and the end position for each peptide is the start position plus eight.

| Pos | Subsequence | Score |
| --- | --- | --- |
| 3 | SVHTRPTDS | 0.007 |
| 1 | PVSVHTRPT | 0.003 |
| 5 | HTRPTDSRT | 0.000 |
| 2 | VSVHTRPTD | 0.000 |
| 4 | VHTRPTDSR | 0.000 |

TABLE XI

109P1D4v.6
C' terminal-A0201-10-mers
Each peptide is a portion of SEQ ID NO: 13; each start position is specified, the length of peptide is 10 amino acids, and the end position for each peptide is the start position plus nine.

| Pos | Subsequence | Score |
| --- | --- | --- |
| 1 | VPYSvHTRPT | 0.017 |
| 5 | VHTRpTDSRT | 0.009 |
| 3 | VSVHtRPTDS | 0.001 |
| 4 | SVHTrPTDSR | 0.001 |
| 2 | PVSVhTRPTD | 0.000 |

TABLE XII

109P1D4v.6
C' terminal-A3-9-mers
Each peptide is a portion of SEQ ID NO: 13; each start position is specified, the length of peptide is 9 amino acids, and the end position for each peptide is the start position plus eight.

| Pos | Subsequence | Score |
| --- | --- | --- |
| 5 | HTRPTDSRT | 0.007 |
| 4 | VHTRPTDSR | 0.006 |
| 3 | SVHTRPTDS | 0.004 |
| 2 | VSVHTRPTD | 0.000 |
| 1 | PVSVHTRPT | 0.000 |

TABLE XIII

109P1D4v.6
C' terminal-A3-10-mers
Each peptide is a portion of SEQ ID NO: 13; each start position is specified, the length of peptide is 10 amino acids, and the end position for each peptide is the start position plus nine.

| Pos | Subsequence | Score |
| --- | --- | --- |
| 4 | SVHTrPTDSR | 0.600 |
| 3 | VSVHtRPTDS | 0.000 |
| 2 | PVSVhTRPTD | 0.000 |
| 1 | VPVSvHTRPT | 0.000 |
| 5 | VHTRpTDSRT | 0.000 |

TABLE XIV

109P1D4v.6
C' terminal-A1101-9-mers
Each peptide is a portion of SEQ ID NO: 13; each start position is specified, the length of peptide is 9 amino acids, and the end position for each peptide is the start position plus eight.

| Pos | Subsequence | Score |
| --- | --- | --- |
| 4 | VHTRPTDSR | 0.004 |
| 3 | SVHTRPTDS | 0.002 |
| 5 | HTRPTDSRT | 0.001 |
| 2 | VSVHTRPTD | 0.000 |
| 1 | PVSVHTRPT | 0.000 |

TABLE XV

109P1D4v.6
C' terminal-A1101-10-mers
Each peptide is a portion of SEQ ID NO: 13; each start position is specified, the length of peptide is 10 amino acids, and the end position for each peptide is the start position plus nine.

| Pos | Subsequence | Score |
| --- | --- | --- |
| 4 | SVHTrPTDSR | 0.400 |
| 2 | PVSVhTRPTD | 0.000 |
| 3 | VSVHtRPTDS | 0.000 |
| 1 | VPVSvHTRPT | 0.000 |
| 5 | VHTRpTDSRT | 0.000 |

TABLE XVI

109P1D4v.6
C' terminal-A24-9-mers
Each peptide is a portion of SEQ
ID NO: 13; each start position is
specified, the length of peptide is 9
amino acids, and the end position
for each peptide is the start
position plus eight.

| Pos | Subsequence | Score |
|---|---|---|
| 5 | HTRPTDSRT | 0.120 |
| 3 | SVHTRPTDS | 0.100 |
| 2 | VSVHTRPTD | 0.015 |
| 1 | PVSVHTRPT | 0.010 |
| 4 | VHTRPTDSR | 0.001 |

TABLE XVII

109P1D4v.6
C' terminal-A24-10-mers
Each peptide is a portion of SEQ
ID NO: 13; each start position is
specified, the length of peptide is
10 amino acids, and the end position
for each peptide is the start
position plus nine.

| Pos | Subsequence | Score |
|---|---|---|
| 3 | VSVHtRPTDS | 0.150 |
| 1 | VPVSvHTRPT | 0.150 |
| 4 | SVHTrPTDSR | 0.010 |
| 5 | VHTRpTDSRT | 0.010 |
| 2 | PVSVhTRPTD | 0.001 |

TABLE XVIII

109P1D4v.6
C' terminal-B7-9-mers
Each peptide is a portion of SEQ
ID NO: 13; each start position is
specified, the length of peptide is 9
amino acids, and the end position
for each peptide is the start
position plus eight.

| Pos | Subsequence | Score |
|---|---|---|
| 5 | HTRPTDSRT | 1.000 |
| 3 | SVHTRPTDS | 0.100 |
| 1 | PVSVHTRPT | 0.050 |
| 2 | VSVHTRPTD | 0.015 |
| 4 | VHTRPTDSR | 0.002 |

TABLE XIX

109P1D4v.6
C' terminal-B7-10-mers
Each peptide is a portion of SEQ
ID NO: 13; each start position is
specified, the length of peptide is
10 amino acids, and the end
position for each peptide is the
start position plus nine.

| Pos | Subsequence | Source |
|---|---|---|
| 1 | VPVSvHTRPT | 2.000 |
| 4 | SVHTrPTDSR | 0.075 |
| 3 | VSVHtRPTDS | 0.020 |
| 5 | VHTRpTDSRT | 0.010 |
| 2 | PVSVhTRPTD | 0.008 |

TABLE XX

109P1D4v.6
C' terminal-B3501-9-mers
Each peptide is a portion of SEQ
ID NO: 13; each start position is
specified, the length of peptide is 9
amino acids, and the end position
for each peptide is the start
position plus eight.

| Pos | Subsequence | Score |
|---|---|---|
| 5 | HTRPTDSRT | 0.300 |
| 3 | SVHTRPTDS | 0.100 |
| 2 | VSVHTRPTD | 0.050 |
| 1 | PVSVHTRPT | 0.010 |
| 4 | VHTRPTDSR | 0.001 |

TABLE XXI

109P1D4v.6
C' terminal-B3501-10-mers
Each peptide is a portion of SEQ
ID NO: 13; each start position is
specified, the length of peptide is
10 amino acids, and the end
position for each peptide is the
start position plus nine.

| Pos | Subsequence | Score |
|---|---|---|
| 1 | VPVSvHTRPT | 2.000 |
| 3 | VSVHtRPTDS | 0.500 |
| 4 | SVHTrPTDSR | 0.010 |
| 5 | VHTRpTDSRT | 0.010 |
| 2 | PVSVhTRPTD | 0.001 |

TABLE VIII

109P1D4v.6
N' terminal-A1-9-mers
Each peptide is a portion of SEQ
ID NO: 13; each start position is
specified, the length of peptide is 9
amino acids, and the end position
for each peptide is the start
position plus eight.

| Pos | Subsequence | Score |
|---|---|---|
| 6 | NSDISSVVR | 15.000 |
| 23 | CLLSGTYIF | 0.200 |
| 14 | RVNTTNCHK | 0.200 |
| 9 | ISSVVRVNT | 0.030 |
| 16 | NTTNCHKCL | 0.025 |
| 1 | MTVGFNSDI | 0.025 |
| 21 | HKCLLSGTY | 0.025 |
| 17 | TTNCHKCLL | 0.025 |
| 10 | SSVVRVNTT | 0.015 |
| 3 | VGFNSDISS | 0.013 |
| 18 | TNCHKCLLS | 0.013 |
| 2 | TVGFNSDIS | 0.010 |
| 22 | KCLLSGTYI | 0.010 |
| 8 | DISSVVRVN | 0.010 |
| 19 | NCHKCLLSG | 0.005 |
| 5 | FNSDISSVV | 0.003 |
| 15 | VNTTNCHKC | 0.003 |
| 7 | SDISSVVRV | 0.001 |
| 11 | SVVRVNTTN | 0.001 |
| 12 | VVRVNTTNC | 0.001 |
| 4 | GFNSDISSV | 0.001 |
| 13 | VRVNTTNCH | 0.001 |
| 20 | CHKCLLSGT | 0.000 |

TABLE IX

109P1D4v.6
N' terminal-A1-10-mers
Each peptide is a portion of SEQ
ID NO: 13; each start position is
specified, the length of peptide is 10
amino acids, and the end position
for each peptide is the start
position plus nine.

| Pos | Subsequence | Score |
|---|---|---|
| 6 | NSDIsSVVRV | 1.500 |
| 22 | KCLLsGTYIF | 0.200 |
| 17 | TTNChKCLLS | 0.125 |
| 5 | FNSDiSSVVR | 0.050 |

TABLE IX-continued

109P1D4v.6
N' terminal-A1-10-mers
Each peptide is a portion of SEQ
ID NO: 13; each start position is
specified, the length of peptide is 10
amino acids, and the end position
for each peptide is the start
position plus nine.

| Pos | Subsequence | Score |
|---|---|---|
| 2 | TVGFnSDISS | 0.050 |
| 23 | CLLSgTYIFA | 0.050 |
| 16 | NTTNcHKCLL | 0.025 |
| 1 | MTVGfNSDIS | 0.025 |
| 8 | DISSvVRVNT | 0.020 |
| 10 | SSVVrVNTTN | 0.015 |
| 9 | ISSVvRVNTT | 0.015 |
| 18 | TNCHkCLLSG | 0.013 |
| 13 | VRVNtTNCHK | 0.010 |
| 14 | RVNTtNGHKC | 0.010 |
| 20 | CHKClLSGTY | 0.003 |
| 15 | VNTTnCHKCL | 0.003 |
| 3 | VGFNsDISSV | 0.003 |
| 19 | NCHKcLLSGT | 0.001 |
| 12 | VVRVnTTNCH | 0.001 |
| 11 | SVVRvNTTNC | 0.001 |
| 7 | SDISsVVRVN | 0.001 |
| 21 | HKCLlSGTYI | 0.001 |
| 4 | GFNSdISSVV | 0.001 |

TABLE X

109P1D4v.6
N' terminal-A0201-9-mers
Each peptide is a portion of SEQ
ID NO: 13; each start position is
specified, the length of peptide is
9 amino acids, and the end
position for each peptide is the
start position plus eight.

| Pos | Subsequence | Score |
|---|---|---|
| 22 | KCLLSGTYI | 4.851 |
| 5 | FNSDISSVV | 3.511 |
| 1 | MTVGFNSDI | 0.936 |
| 16 | NTTNCHKCL | 0.297 |
| 17 | TTNCHKCLL | 0.297 |
| 7 | SDISSVVRV | 0.222 |
| 23 | CLLSGTYIF | 0.113 |

TABLE X-continued

109P1D4v.6  
N' terminal-A0201-9-mers  
Each peptide is a portion of SEQ ID NO: 13; each start position is specified, the length of peptide is 9 amino acids, and the end position for each peptide is the start position plus eight.

| Pos | Subsequence | Score |
|---|---|---|
| 10 | SSVVRVNTT | 0.112 |
| 4 | GFNSDISSV | 0.111 |
| 9 | ISSVVRVNT | 0.083 |
| 12 | VVRVNTTNC | 0.056 |
| 15 | VNTTNCHKC | 0.055 |
| 11 | SVVRVNTTN | 0.007 |
| 3 | VGFNSDISS | 0.003 |
| 2 | TVGFNSDIS | 0.001 |
| 14 | RVNTTNCHK | 0.001 |
| 19 | NCHKCLLSG | 0.001 |
| 18 | TNCHKCLLS | 0.000 |
| 20 | CHKCLLSGT | 0.000 |
| 8 | DISSVVRVN | 0.000 |
| 13 | VRVNTTNCH | 0.000 |
| 6 | NSDISSVVR | 0.000 |
| 21 | HKCLLSGTY | 0.000 |

TABLE XI

109P1D4v.6  
N' terminal-A0201-10-mers  
Each peptide is a portion of SEQ ID NO: 13; each start position is specified, the length of peptide is 10 amino acids, and the end position for each peptide is the start position plus nine.

| Pos | Subsequence | Score |
|---|---|---|
| 23 | CLLSgTYIFA | 151.648 |
| 3 | VGFNsDISSV | 6.568 |
| 14 | RVNTtNCHKC | 0.435 |
| 11 | SVVRvNTTNC | 0.435 |
| 6 | NSDIsSVVRV | 0.418 |
| 16 | NTTNcHKCLL | 0.297 |
| 15 | VNTTnCHKCL | 0.237 |
| 9 | ISSVvRVNTT | 0.190 |
| 19 | NCHKcLLSGT | 0.112 |
| 8 | DISSvVRVNT | 0.077 |
| 4 | GFNSdISSVV | 0.020 |

TABLE XI-continued

109P1D4v.6  
N' terminal-A0201-10-mers  
Each peptide is a portion of SEQ ID NO: 13; each start position is specified, the length of peptide is 10 amino acids, and the end position for each peptide is the start position plus nine.

| Pos | Subsequence | Score |
|---|---|---|
| 2 | TVGFnSDISS | 0.007 |
| 21 | HKCLlSGTYI | 0.003 |
| 22 | KCLLsGTYIF | 0.003 |
| 18 | TNCHkCLLSG | 0.001 |
| 17 | TTNChKCLLS | 0.001 |
| 12 | VVRVnTTNCH | 0.001 |
| 5 | FNSDiSSVVR | 0.001 |
| 10 | SSVVrVNTTN | 0.000 |
| 1 | MTVGfNSDIS | 0.000 |
| 7 | SDISsVVRVN | 0.000 |
| 13 | VRVNtTNCHK | 0.000 |
| 20 | CHKClLSGTY | 0.000 |

TABLE XII

109P1D4v.6  
N' terminal-A3-9-mers  
Each peptide is a portion of SEQ ID NO: 13; each start position is specified, the length of peptide is 9 amino acids, and the end position for each peptide is the start position plus eight.

| Pos | Subsequence | Score |
|---|---|---|
| 23 | CLLSGTYIF | 9.000 |
| 14 | RVNTTNCHK | 2.000 |
| 1 | MTVGFNSDI | 0.203 |
| 17 | TTNCHKCLL | 0.030 |
| 22 | KCLLSGTYI | 0.027 |
| 6 | NSDISSVVR | 0.020 |
| 12 | VVRVNTTNC | 0.020 |
| 16 | NTTNCHKCL | 0.015 |
| 11 | SVVRVNTTN | 0.005 |
| 2 | TVGFNSDIS | 0.004 |
| 10 | SSVVRVNTT | 0.002 |
| 21 | HKCLLSGTY | 0.001 |
| 7 | SDISSVVRV | 0.001 |
| 4 | GFNSDISSV | 0.001 |

TABLE XII-continued

109P1D4v.6
N' terminal-A3-9-mers
Each peptide is a portion of SEQ
ID NO: 13; each start position is
specified, the length of peptide is 9
amino acids, and the end position
for each peptide is the start
position plus eight.

| Pos | Subsequence | Score |
|---|---|---|
| 9 | ISSVVRVNT | 0.001 |
| 19 | NCHKCLLSG | 0.001 |
| 5 | FNSDISSVV | 0.001 |
| 15 | VNTTNCHKC | 0.000 |
| 3 | VGFNSDISS | 0.000 |
| 13 | VRVNTTNCH | 0.000 |
| 8 | DISSVVRVN | 0.000 |
| 18 | TNCHKCLLS | 0.000 |
| 20 | CHKCLLSGT | 0.000 |

TABLE XIII

109P1D4v.6
N' terminal-A3-10-mers
Each peptide is a portion of SEQ
ID NO: 13; each start position is
specified, the length of peptide is 10
amino acids, and the end position
for each peptide is the start
position plus nine.

| Pos | Subsequence | Score |
|---|---|---|
| 23 | CLLSgTYIFA | 0.600 |
| 22 | KCLLsGTYIF | 0.270 |
| 13 | VRVNtTNCHK | 0.030 |
| 16 | NTTNcHKCLL | 0.030 |
| 11 | SVVRvNTTNC | 0.030 |
| 14 | RVNTtNCHKC | 0.020 |
| 12 | VVRVnTTNCH | 0.020 |
| 5 | FNSDiSSVVR | 0.008 |
| 2 | TVGFnSDISS | 0.008 |
| 1 | MTVGfNSDIS | 0.005 |
| 8 | DISSvVRVNT | 0.005 |
| 17 | TTNChKCLLS | 0.004 |
| 6 | NSDIsSVVRV | 0.003 |
| 3 | VGFNsDISSV | 0.002 |
| 9 | ISSVvRVNTT | 0.002 |
| 19 | NCHKcLLSGT | 0.002 |
| 20 | CHKClLSGTY | 0.001 |
| 4 | GFNSdISSVV | 0.001 |

TABLE XIII-continued

109P1D4v.6
N' terminal-A3-10-mers
Each peptide is a portion of SEQ
ID NO: 13; each start position is
specified, the length of peptide is 10
amino acids, and the end position
for each peptide is the start
position plus nine.

| Pos | Subsequence | Score |
|---|---|---|
| 15 | VNTTnCHKCL | 0.001 |
| 21 | HKCLlSGTYI | 0.001 |
| 10 | SSVVrVNTTN | 0.000 |
| 18 | TNCHkCLLSG | 0.000 |
| 7 | SDISsVVRVN | 0.000 |

TABLE XIV

109P1D4v.6
N' terminal-A1101-9-mers
Each peptide is a portion of SEQ ID
NO: 13; each start position is
specified, the length of peptide is 9
amino acids, and the end position for
each peptide is the start position plus
eight.

| Pos | Subsequence | Score |
|---|---|---|
| 14 | RVNTTNCHK | 6.000 |
| 1 | MTVGFNSDI | 0.015 |
| 23 | CLLSGTYIF | 0.012 |
| 17 | TTNCHKCLL | 0.010 |
| 22 | KCLLSGTYI | 0.009 |
| 4 | GFNSDISSV | 0.006 |
| 16 | NTTNCHKCL | 0.005 |
| 6 | NSDISSVVR | 0.004 |
| 11 | SVVRVNTTN | 0.003 |
| 12 | VVRVNTTNC | 0.002 |
| 2 | TVGFNSDIS | 0.002 |
| 19 | NCHKCLLSG | 0.000 |
| 5 | FNSDISSVV | 0.000 |
| 7 | SDISSVVRV | 0.000 |
| 13 | VRVNTTNCH | 0.000 |
| 21 | HKCLLSGTY | 0.000 |
| 3 | VGFNSDISS | 0.000 |
| 18 | TNCHKCLLS | 0.000 |
| 15 | VNTTNCHKC | 0.000 |
| 10 | SSVVRVNTT | 0.000 |
| 9 | ISSVVRVNT | 0.000 |

TABLE XIV-continued

109P1D4v.6
N' terminal-A1101-9-mers
Each peptide is a portion of SEQ ID
NO: 13; each start position is
specified, the length of peptide is 9
amino acids, and the end position for
each peptide is the start position plus
eight.

| Pos | Subsequence | Score |
|---|---|---|
| 20 | CHKCLLSGT | 0.000 |
| 8 | DISSVVRVN | 0.000 |

TABLE XV

109P1D4v.6
N' terminal-A1101-10-mers
Each peptide is a portion of SEQ ID
NO: 13; each start position is
specified, the length of peptide is 10
amino acids, and the end position for
each peptide is the start position plus
nine.

| Pos | Subsequence | Score |
|---|---|---|
| 13 | VRVNtTNCHK | 0.030 |
| 12 | VVRVnTTNCH | 0.020 |
| 22 | KCLLsGTYIF | 0.018 |
| 23 | CLLSgTYIFA | 0.012 |
| 16 | NTTNcHKCLL | 0.010 |
| 5 | FNSDiSSVVR | 0.008 |
| 14 | RVNtTNCHKC | 0.006 |
| 4 | GFNSdISSVV | 0.006 |
| 2 | TVGFnSDISS | 0.004 |
| 11 | SVVRvNTTNC | 0.003 |
| 17 | TTNChKCLLS | 0.002 |
| 1 | MTVGfNSDIS | 0.002 |
| 3 | VGFNsDISSV | 0.000 |
| 19 | NCHKcLLSGT | 0.000 |
| 6 | NSDIsSVVRV | 0.000 |
| 20 | CHKClLSGTY | 0.000 |
| 15 | VNTTnCHKCL | 0.000 |
| 21 | HKCLlSGTYI | 0.000 |
| 8 | DISSvVRVNT | 0.000 |
| 18 | TNCHkCLLSG | 0.000 |
| 10 | SSVVrVNTTN | 0.000 |
| 9 | ISSVvRVNTT | 0.000 |
| 7 | SDISsVVRVN | 0.000 |

TABLE XVI

109P1D4v.6
N' terminal-A24-9-mers
Each peptide is a portion of
SEQ ID NO: 13; each start
position is specified, the length
of peptide is 9 amino acids, and
the end position for each
peptide is the start position plus
eight.

| Pos | Subsequence | Score |
|---|---|---|
| 17 | TTNCHKCLL | 6.000 |
| 16 | NTTNCHKCL | 4.000 |
| 23 | CLLSGTYIF | 3.000 |
| 22 | KCLLSGTYI | 3.000 |
| 1 | MTVGFNSDI | 1.500 |
| 4 | GFNSDISSV | 0.750 |
| 11 | SVVRVNTTN | 0.210 |
| 10 | ISSWRVNTT | 0.180 |
| 5 | FNSDISSVV | 0.168 |
| 8 | DISSVVRVN | 0.140 |
| 9 | ISSVVRVNT | 0.140 |
| 15 | VNTTNCHKC | 0.110 |
| 2 | TVGFNSDIS | 0.100 |
| 18 | TNCHKCLLS | 0.100 |
| 3 | VGFNSDISS | 0.100 |
| 12 | VVRVNTTNC | 0.100 |
| 14 | RVNTTNCHK | 0.030 |
| 7 | SDISSVVRV | 0.015 |
| 21 | HKCLLSGTY | 0.012 |
| 20 | CHKCLLSGT | 0.012 |
| 6 | NSDISSVVR | 0.010 |
| 19 | NCHKCLLSG | 0.010 |
| 13 | VRVNTTNCH | 0.002 |

TABLE XVII

109P1D4v.6
N' terminal-A24-10-mers
Each peptide is a portion of SEQ
ID NO: 13; each start position is
specified, the length of peptide is
10 amino acids, and the end
position for each peptide is the
start position plus nine.

| Pos | Subsequence | Score |
|---|---|---|
| 22 | KCLLsGTYIF | 6.000 |
| 16 | NTTNcHKCLL | 4.000 |
| 15 | VNTTnCHKCL | 4.000 |

TABLE XVII-continued

109P1D4v.6
N' terminal-A24-10-mers
Each peptide is a portion of SEQ
ID NO: 13; each start position is
specified, the length of peptide is
10 amino acids, and the end
position for each peptide is the
start position plus nine.

| Pos | Subsequence | Score |
| --- | --- | --- |
| 4 | GFNSdISSVV | 1.050 |
| 14 | RVNTtNCHKC | 0.330 |
| 10 | SSVVrVNTTN | 0.210 |
| 17 | TTNChKCLLS | 0.150 |
| 1 | MTVGfNSDIS | 0.150 |
| 11 | SVVRvNTTNC | 0.150 |
| 23 | CLLSgTYIFA | 0.150 |
| 8 | DISSvVRVNT | 0.140 |
| 9 | ISSVvRVNTT | 0.120 |
| 19 | NCHKcLLSGT | 0.120 |
| 21 | HKCLlSGTYI | 0.100 |
| 2 | TVGFnSDISS | 0.100 |
| 6 | NSDIsSVVRV | 0.100 |
| 3 | VGFNsDISSV | 0.100 |
| 7 | SDISsVVRVN | 0.021 |
| 20 | CHKClLSGTY | 0.012 |
| 5 | FNSDiSSVVR | 0.012 |
| 12 | VVRVnTTNCH | 0.012 |
| 18 | TNCHkCLLSG | 0.010 |
| 13 | VRVNtTNCHK | 0.002 |

TABLE XVIII

109P1D4v.6
N' terminal-B7-9-mers
Each peptide is a portion of SEQ
ID NO: 13; each start position is
specified, the length of peptide is
9 amino acids, and the end
position for each peptide is the
start position plus eight.

| Pos | Subsequence | Score |
| --- | --- | --- |
| 12 | VVRVNTTNC | 5.000 |
| 16 | NTTNCHKCL | 4.000 |
| 17 | TTNCHKCLL | 4.000 |
| 1 | MTVGFNSDI | 0.400 |
| 22 | KCLLSGTYI | 0.400 |
| 5 | FNSDISSVV | 0.200 |
| 9 | ISSVVRVNT | 0.150 |
| 10 | SSVVRVNTT | 0.100 |
| 11 | SVVRVNTTN | 0.100 |
| 2 | TVGFNSDIS | 0.100 |
| 15 | VNTTNCHKC | 0.100 |
| 14 | RVNTTNCHK | 0.050 |
| 8 | DISSVVRVN | 0.020 |
| 4 | GFNSDISSV | 0.020 |
| 18 | TNCHKCLLS | 0.020 |
| 7 | SDISSVVRV | 0.020 |
| 23 | CLLSGTYIF | 0.020 |
| 3 | VGFNSDISS | 0.020 |
| 20 | CHKCLLSGT | 0.010 |
| 19 | NCHKCLLSG | 0.010 |
| 6 | NSDISSVVR | 0.003 |
| 21 | HKCLLSGTY | 0.002 |
| 13 | VRVNTTNCH | 0.001 |

TABLE XIX

109P1D4v.61
N' terminal-B7-10-mers
Each peptide is a portion of SEQ
ID NO: 13; each start position is
specified, the length of peptide is
10 amino acids, and the end
position for each peptide is the
start position plus nine.

| Pos | Subsequence | Score |
| --- | --- | --- |
| 16 | NTTNcHKCLL | 4.000 |
| 15 | VNTTnCHKCL | 4.000 |
| 11 | SVVRvNTTNC | 0.500 |
| 14 | RVNTtNCHKC | 0.500 |
| 12 | VVRVnTTNCH | 0.500 |
| 3 | VGFNsDISSV | 0.200 |
| 8 | DISSvVRVNT | 0.150 |
| 19 | NCHKcLLSGT | 0.100 |
| 9 | ISSVvRVNTT | 0.100 |
| 23 | CLLSgTYIFA | 0.100 |

TABLE XIX-continued

109P1D4v.61
N' terminal-B7-10-mers
Each peptide is a portion of SEQ
ID NO: 13; each start position is
specified, the length of peptide is
10 amino acids, and the end
position for each peptide is the
start position plus nine.

| Pos | Subsequence | Score |
|---|---|---|
| 2 | TVGFnSDISS | 0.100 |
| 6 | NSDIsSVVRV | 0.060 |
| 21 | HKCLlSGTYI | 0.040 |
| 4 | GFNSdISSVV | 0.020 |
| 22 | KCLLsGTYIF | 0.020 |
| 10 | SSVVrVNTTN | 0.020 |
| 1 | MTVGfNSDIS | 0.020 |
| 17 | TTNChKCLLS | 0.020 |
| 18 | TNCHkCLLSG | 0.010 |
| 5 | FNSDiSSVVR | 0.010 |
| 7 | SDISsVVRVN | 0.002 |
| 20 | CHKClLSGTY | 0.002 |
| 13 | VRVNtTNCHK | 0.001 |

TABLE XX

109P1D4v.6
N' terminal-B3501-9-mers
Each peptide is a portion of SEQ
ID NO: 13; each start position is
specified, the length of peptide is 9
amino acids, and the end position
for each peptide is the start
position plus eight.

| Pos | Subsequence | Score |
|---|---|---|
| 16 | NTTNCHKCL | 1.000 |
| 23 | CLLSGTYIF | 1.000 |
| 17 | TTNCHKCLL | 1.000 |
| 22 | KCLLSGTYI | 0.800 |
| 9 | ISSVVRVNT | 0.500 |
| 10 | SSVVRVNTT | 0.500 |
| 1 | MTVGFNSDI | 0.400 |
| 5 | FNSDISSVV | 0.400 |
| 12 | VVRVNTTNC | 0.300 |
| 21 | HKCLLSGTY | 0.200 |
| 2 | TVGFNSDIS | 0.100 |
| 8 | DISSVVRVN | 0.100 |
| 18 | TNCHKCLLS | 0.100 |
| 15 | VNTTNCHKC | 0.100 |

TABLE XX-continued

109P1D4v.6
N' terminal-B3501-9-mers
Each peptide is a portion of SEQ
ID NO: 13; each start position is
specified, the length of peptide is 9
amino acids, and the end position
for each peptide is the start
position plus eight.

| Pos | Subsequence | Score |
|---|---|---|
| 3 | VGFNSDISS | 0.100 |
| 11 | SVVRVNTTN | 0.100 |
| 20 | CHKCLLSGT | 0.030 |
| 4 | GFNSDISSV | 0.030 |
| 7 | SDISSVVRV | 0.020 |
| 14 | RVNTTNCHK | 0.020 |
| 6 | NSDISSVVR | 0.015 |
| 19 | NCHKCLLSG | 0.010 |
| 13 | VRVNTTNCH | 0.001 |

TABLE XXI

109P1D4v.6
N' terminal-B3501-10-mers
Each peptide is a portion of SEQ
ID NO: 13; each start position is
specified, the length of peptide is
10 amino acids, and the end
position for each peptide is the
start position plus nine.

| Pos | Subsequence | Score |
|---|---|---|
| 22 | KCLLsGTYIF | 2.000 |
| 16 | NTTNcHKCLL | 1.000 |
| 15 | VNTTnCHKCL | 1.000 |
| 20 | CHKClLSGTY | 0.600 |
| 9 | ISSVvRVNTT | 0.500 |
| 10 | SSVVrVNTTN | 0.500 |
| 6 | NSDIsSVVRV | 0.300 |
| 3 | VGFNsDISSV | 0.300 |
| 14 | RVNTtNCHKC | 0.200 |
| 19 | NCHKcLLSGT | 0.100 |
| 2 | TVGFnSDISS | 0.100 |
| 8 | DISSvVRVNT | 0.100 |
| 1 | MTVGfNSDIS | 0.100 |
| 23 | CLLSgTYIFA | 0.100 |
| 17 | TTNChKCLLS | 0.100 |
| 11 | SvVRvNTTNC | 0.100 |
| 21 | HKCLlSGTYI | 0.040 |

TABLE XXI-continued

109P1D4v.6
N' terminal-B3501-10-mers
Each peptide is a portion of SEQ ID NO: 13; each start position is specified, the length of peptide is 10 amino acids, and the end position for each peptide is the start position plus nine.

| Pos | Subsequence | Score |
|---|---|---|
| 12 | VVRVnTTNCH | 0.030 |
| 4 | GFNSdISSVV | 0.020 |
| 5 | FNSDiSSVVR | 0.020 |
| 18 | TNCHkCLLSG | 0.010 |
| 7 | SDISsVVRVN | 0.010 |
| 13 | VRVNtTNCHK | 0.001 |

TABLE VIII

109P1D4v.7
N' terminal-A1-9-mers
Each peptide is a portion of SEQ ID NO: 15; each start position is specified, the length of peptide is 9 amino acids, and the end position for each peptide is the start position plus eight.

| Pos | Subsequence | Score |
|---|---|---|
| 14 | SLSPLLLVS | 0.500 |
| 12 | SSSLSPLLL | 0.075 |
| 13 | SSLSPLLLV | 0.075 |
| 3 | RVGFLIISS | 0.050 |
| 15 | LSPLLLVSV | 0.030 |
| 11 | SSSSLSPLL | 0.030 |
| 17 | PLLLVSVVR | 0.020 |
| 18 | LLLVSVVRV | 0.020 |
| 20 | LVSVVRVNT | 0.020 |
| 10 | SSSSSLSPL | 0.015 |
| 21 | VSVVRVNTT | 0.015 |
| 19 | LLVSVVRVN | 0.010 |
| 8 | IISSSSSLS | 0.010 |
| 6 | FLIISSSSS | 0.010 |
| 7 | LIISSSSSL | 0.010 |
| 9 | ISSSSSLSP | 0.007 |
| 4 | VGFLIISSS | 0.003 |
| 2 | FRVGFLIIS | 0.003 |
| 16 | SPLLLVSVV | 0.003 |

TABLE VIII-continued

109P1D4v.7
N' terminal-A1-9-mers
Each peptide is a portion of SEQ ID NO: 15; each start position is specified, the length of peptide is 9 amino acids, and the end position for each peptide is the start position plus eight.

| Pos | Subsequence | Score |
|---|---|---|
| 5 | GFLIISSSS | 0.001 |
| 1 | MFRVGFLII | 0.000 |

TABLE IX

109P1D4v.7
N' terminal-A1-10-mers
Each peptide is a portion of SEQ ID. NO: 15; each start position is specified, the length of peptide is 10 amino acids, and the end position for each peptide is the start position plus nine.

| Pos | Subsequence | Score |
|---|---|---|
| 14 | ALSPlLLVSV | 0.200 |
| 12 | SSSLsPLLLV | 0.075 |
| 11 | SSSSlSPLLL | 0.075 |
| 13 | SSLSpLLLVS | 0.075 |
| 16 | SPLLlVSVVR | 0.050 |
| 10 | SSSSsLSPLL | 0.030 |
| 19 | LLVSvVRVNT | 0.020 |
| 15 | LSPLlLVSVV | 0.015 |
| 21 | VSVVrVNTTN | 0.015 |
| 9 | ISSSsSLSPL | 0.015 |
| 6 | FLIIsSSSSL | 0.010 |
| 18 | LLLVsVVRVN | 0.010 |
| 20 | LVSVvRVNTT | 0.010 |
| 3 | RVGFlIISSS | 0.010 |
| 7 | LIISsSSSLS | 0.010 |
| 8 | IISSsSSLSP | 0.005 |
| 4 | VGFLiISSSS | 0.003 |
| 2 | FRVGfLIISS | 0.003 |
| 17 | PLLLvSVVRV | 0.002 |
| 5 | GFLIiSSSSS | 0.001 |
| 1 | MFRVgFLIIS | 0.000 |

TABLE X

109P1D4v.7
N' terminal-A0201-9-mers
Each peptide is a portion of SEQ ID NO: 15;
each start position is specified, the length
of peptide is 9 amino acids, and the end position
for each peptide is the start position plus eight.

| Pos | Subsequence | Score |
|---|---|---|
| 18 | LLLVSVVRV | 1006.209 |
| 7 | LIISSSSSL | 4.993 |
| 13 | SSLSPLLLV | 3.864 |
| 15 | LSPLLLVSV | 1.775 |
| 16 | SPLLLVSVV | 1.584 |
| 20 | LVSVVRVNT | 1.108 |
| 6 | FLIISSSSS | 0.343 |
| 10 | SSSSSLSPL | 0.321 |
| 21 | VSVVRVNTT | 0.190 |
| 11 | SSSSLSPLL | 0.139 |
| 12 | SSSLSPLLL | 0.139 |
| 14 | SLSPLLLVS | 0.070 |
| 19 | LLVSVVRVN | 0.024 |
| 8 | IISSSSSLS | 0.017 |
| 3 | RVGFLIISS | 0.015 |
| 4 | VGFLIISSS | 0.007 |
| 1 | MFRVGFLII | 0.001 |
| 17 | PLLLVSVVR | 0.000 |
| 5 | GFLIISSSS | 0.000 |
| 2 | FRVGFLIIS | 0.000 |
| 9 | ISSSSSLSP | 0.000 |

TABLE XI

109P1D4v.7
N' terminal-A0201-10-mers
Each peptide is a portion of SEQ ID NO: 15;
each start position is specified, the length
of peptide is 10 amino acids, and the end position
for each peptide is the start position plus nine.

| Pos | Subsequence | Score |
|---|---|---|
| 14 | SLSPlLLVSV | 159.970 |
| 6 | FLIIsSSSSL | 98.267 |
| 17 | PLLLvSVVRV | 13.022 |
| 19 | LLVSvVRVNT | 12.668 |
| 20 | LVSVvRVNTT | 2.550 |
| 12 | SSSLsPLLLV | 1.044 |
| 15 | LSPLlLVSVV | 0.728 |
| 9 | ISSSsSLSPL | 0.545 |
| 11 | SSSSlSPLLL | 0.139 |
| 10 | SSSSsLSPLL | 0.139 |
| 18 | LLLVsVVRVN | 0.088 |
| 7 | LIISsSSSLS | 0.017 |
| 3 | RVGFlIISSS | 0.015 |
| 8 | IISSsSSLSP | 0.003 |
| 4 | VGFLiISSSS | 0.003 |
| 13 | SSLSpLLLVS | 0.002 |
| 21 | VSVVrVNTTN | 0.001 |
| 5 | GFLIiSSSSS | 0.000 |
| 16 | SPLLlVSVVR | 0.000 |
| 2 | FRVGfLIISS | 0.000 |
| 1 | MFRVgFLIIS | 0.000 |

TABLE XII

109P1D4v.7
N' terminal-A3-9-mers
Each peptide is a portion of SEQ ID NO: 15;
each start position is specified, the length
of peptide is 9 amino acids, and the end position
for each peptide is the start position plus eight.

| Pos | Subsequence | Score |
|---|---|---|
| 17 | PLLLVSVVR | 0.900 |
| 18 | LLLVSVVRV | 0.900 |
| 14 | SLSPLLLVS | 0.180 |
| 7 | LIISSSSSL | 0.090 |
| 6 | FLIISSSSS | 0.060 |
| 20 | LVSVVRVNT | 0.015 |
| 19 | LLVSVVRVN | 0.013 |
| 3 | RVGFLIISS | 0.012 |
| 16 | SPLLLVSVV | 0.009 |
| 13 | SSLSPLLLV | 0.007 |
| 12 | SSSLSPLLL | 0.006 |
| 10 | SSSSSLSPL | 0.005 |
| 8 | IISSSSSLS | 0.004 |
| 1 | MFRVGFLII | 0.004 |
| 11 | SSSSLSPLL | 0.003 |

TABLE XII-continued

109P1D4v.7
N' terminal-A-9-mers
Each peptide is a portion of SEQ ID NO: 15;
each start position is specified, the length
of peptide is 9 amino acids, and the end position
for each peptide is the start position plus eight.

| Pos | Subsequence | Score |
|---|---|---|
| 21 | VSVVRVNTT | 0.002 |
| 15 | LSPLLLVSV | 0.002 |
| 2 | FRVGFLIIS | 0.001 |
| 4 | VGFLIISSS | 0.000 |
| 5 | GFLIISSSS | 0.000 |
| 9 | ISSSSSLSP | 0.000 |

TABLE XIII

109P1D4v.7
N' terminal-A3-10-mers
Each peptide is a portion of SEQ ID NO: 15;
each start position is specified, the length
of peptide is 10 amino acids, and the end position
each peptide is the start position plus nine.

| Pos | Subsequence | Score |
|---|---|---|
| 6 | FLIIsSSSSL | 0.900 |
| 14 | SLSP1LLVSV | 0.450 |
| 19 | LLVSvVRVNT | 0.225 |
| 16 | SPLL1VSVVR | 0.090 |
| 17 | PLLLvSVVRV | 0.090 |
| 20 | LVSVvRVNTT | 0.030 |
| 18 | LLLVsVVRVN | 0.013 |
| 3 | RVGF1IISSS | 0.009 |
| 7 | LIISsSSSLS | 0.006 |
| 11 | SSSS1SPLLL | 0.006 |
| 12 | SSSLsPLLLV | 0.005 |
| 9 | ISSSsSLSPL | 0.005 |
| 8 | IISSsSSLSP | 0.004 |
| 10 | SSSSsLSPLL | 0.003 |
| 15 | LSPL1LVSVV | 0.003 |
| 13 | SSLSpLLLVS | 0.001 |
| 1 | MFRVgFLIIS | 0.000 |
| 4 | VGFLiISSSS | 0.000 |
| 2 | FRVGfLIISS | 0.000 |
| 21 | VSVVrVNTTN | 0.000 |
| 5 | GFLIiSSSSS | 0.000 |

TABLE XIV

109P1D4v.7
N' terminal-A1101-9-mers
Each peptide is a portion of SEQ ID NO: 15;
each start position is specified, the length
of peptide is 9 amino acids, and the end position
for each peptide is the start position plus eight.

| Pos | Subsequence | Score |
|---|---|---|
| 17 | PLLLVSVVR | 0.012 |
| 3 | RVGFLIISS | 0.012 |
| 18 | LLLVSVVRV | 0.006 |
| 7 | LIISSSSSL | 0.006 |
| 1 | MFRVGFLII | 0.004 |
| 16 | SPLLLVSVV | 0.003 |
| 20 | LVSVVRVNT | 0.002 |
| 5 | GFLIISSSS | 0.001 |
| 14 | SLSPLLLVS | 0.001 |
| 13 | SSLSPLLLV | 0.001 |
| 6 | FLIISSSSS | 0.001 |
| 8 | IISSSSSLS | 0.000 |
| 12 | SSSLSPLLL | 0.000 |
| 10 | SSSSSLSPL | 0.000 |
| 11 | SSSSLSPLL | 0.000 |
| 15 | LSPLLLVSV | 0.000 |
| 2 | FRVGFLIIS | 0.000 |
| 19 | LLVSVVRVN | 0.000 |
| 9 | ISSSSSLSP | 0.000 |
| 4 | VGFLIISSS | 0.000 |
| 21 | VSVVRVNTT | 0.000 |

TABLE XV

109P1D4v.7
N' terminal-A1101-10-mers
Each peptide is a portion of SEQ ID NO: 15;
each start position is specified, the length
of peptide is 10 amino acids, and the end position
for each peptide is the start position plus nine.

| Pos | Subsequence | Score |
|---|---|---|
| 16 | SPLL1VSVVR | 0.060 |
| 6 | FLIIsSSSSL | 0.006 |
| 3 | RVGF1IISSS | 0.006 |
| 14 | SLSP1LLVSV | 0.004 |
| 20 | LVSVvRVNTT | 0.002 |
| 5 | GFLIiSSSSS | 0.001 |
| 8 | IISSsSSLSP | 0.001 |
| 17 | PLLLvSVVRV | 0.001 |

TABLE XV-continued

109P1D4v.7
N' terminal-A1101-10-mers
Each peptide is a portion of SEQ ID NO: 15;
each start position is specified, the length
of peptide is 10 amino acids, and the end position
for each peptide is the start position plus nine.

| Pos | Subsequence | Score |
|---|---|---|
| 7 | LIISsSSSLS | 0.001 |
| 19 | LLVSvVRVNT | 0.001 |
| 11 | SSSSlSPLLL | 0.000 |
| 1 | MFRVgFLIIS | 0.000 |
| 12 | SSSLsPLLLV | 0.000 |
| 10 | SSSSsLSPLL | 0.000 |
| 15 | LSPLlLVSVV | 0.000 |
| 9 | ISSSsSLSPL | 0.000 |
| 18 | LLLVsVVRVN | 0.000 |
| 13 | SSLSpLLLVS | 0.000 |
| 2 | FRVGfLIISS | 0.000 |
| 4 | VGFLiISSSS | 0.000 |
| 21 | VSVVrVNTTN | 0.000 |

TABLE XVI

109P1D4v.7
N' terminal-A24-9-mers
Each peptide is a portion of SEQ ID NO: 15;
each start position is specified, the length
of peptide is 9 amino acids, and the end position
for each peptide is the start position plus eight.

| Pos | Subsequence | Score |
|---|---|---|
| 7 | LIISSSSSL | 6.000 |
| 1 | MFRVGFLII | 6.000 |
| 11 | SSSSLSPLL | 4.800 |
| 12 | SSSLSPLLL | 4.000 |
| 10 | SSSSSLSPL | 4.000 |
| 5 | GFLIISSSS | 1.050 |
| 3 | RVGFLIISS | 0.240 |
| 19 | LLVSVVRVN | 0.210 |
| 15 | LSPLLLVSV | 0.180 |
| 16 | SPLLLVSVV | 0.180 |
| 21 | VSVVRVNTT | 0.180 |
| 18 | LLLVSVVRV | 0.150 |
| 13 | SSLSPLLLV | 0.150 |
| 6 | FLIISSSSS | 0.150 |
| 14 | SLSPLLLVS | 0.144 |
| 20 | LVSVVRVNT | 0.140 |

TABLE XVI-continued

109P1D4v.7
N' terminal-A24-9-mers
Each peptide is a portion of SEQ ID NO: 15;
each start position is specified, the length
of peptide is 9 amino acids, and the end position
for each peptide is the start position plus eight.

| Pos | Subsequence | Score |
|---|---|---|
| 4 | VGFLIISSS | 0.140 |
| 8 | IISSSSSLS | 0.100 |
| 2 | FRVGFLIIS | 0.015 |
| 9 | ISSSSSLSP | 0.010 |
| 17 | PLLLVSVVR | 0.002 |

TABLE XVII

109P1D4v.7
N' terminal-A24-10-mers
Each peptide is a portion of SEQ ID NO: 15;
each start position is specified, the length
of peptide is 10 amino acids, and the end position
for each peptide is the start position plus nine.

| Pos | Subsequence | Score |
|---|---|---|
| 6 | FLIIsSSSSL | 6.000 |
| 10 | SSSSsLSPLL | 4.800 |
| 11 | SSSSlSPLLL | 4.000 |
| 9 | ISSSsSLSPL | 4.000 |
| 5 | GFLIiSSSSS | 0.750 |
| 1 | MFRVgFLIIS | 0.500 |
| 3 | RVGFlIISSS | 0.280 |
| 19 | LLVSvVRVNT | 0.210 |
| 21 | VSVVrVNTTN | 0.210 |
| 18 | LLLVsVVRVN | 0.210 |
| 15 | LSPLlLVSVV | 0.180 |
| 13 | SSLSpLLLVS | 0.180 |
| 7 | LIISsSSSLS | 0.150 |
| 14 | SLSPlLLVSV | 0.144 |
| 4 | VGFLiISSSS | 0.140 |
| 20 | LVSVvRVNTT | 0.120 |
| 12 | SSSLsPLLLV | 0.100 |
| 16 | SPLLlVSVVR | 0.021 |
| 2 | FRVGfLIISS | 0.018 |
| 17 | PLLLvSVVRV | 0.015 |
| 8 | IISSsSSLSP | 0.010 |

TABLE XVIII

109P1D4v.7
N' terminal-B7-9-mers
Each peptide is a portion of SEQ ID NO: 15;
each start position is specified, the length
of peptide is 9 amino acids, and the end position
for each peptide is the start position plus eight.

| Pos | Subsequence | Score |
|---|---|---|
| 16 | SPLLLVSVV | 4.000 |
| 11 | SSSSLSPLL | 4.000 |
| 12 | SSSLSPLLL | 4.000 |
| 7 | LIISSSSSL | 4.000 |
| 10 | SSSSSLSPL | 4.000 |
| 20 | LVSVVRVNT | 0.750 |
| 1 | MFRVGFLII | 0.400 |
| 13 | SSLSPLLLV | 0.300 |
| 15 | LSPLLLVSV | 0.200 |
| 18 | LLLVSVVRV | 0.200 |
| 21 | VSVVRVNTT | 0.100 |
| 3 | RVGFLIISS | 0.100 |
| 14 | SLSPLLLVS | 0.020 |
| 19 | LLVSVVRVN | 0.020 |
| 4 | VGFLIISSS | 0.020 |
| 8 | IISSSSSLS | 0.020 |
| 6 | FLIISSSSS | 0.020 |
| 9 | ISSSSSLSP | 0.010 |
| 5 | GFLIISSSS | 0.002 |
| 2 | FRVGFLIIS | 0.002 |
| 17 | PLLLVSVVR | 0.001 |

TABLE XIX

109P1D4v.7
N' terminal-B7-10-mers
Each peptide is a portion of SEQ ID NO: 15;
each start position is specified, the length
of peptide is 10 amino acids, and the end position
for each peptide is the start position plus nine.

| Pos | Subsequence | Score |
|---|---|---|
| 9 | ISSSsSLSPL | 4.000 |
| 11 | SSSSlSPLLL | 4.000 |
| 10 | SSSSsLSPLL | 4.000 |
| 6 | FLIIsSSSSL | 4.000 |
| 20 | LVSVvRVNTT | 0.500 |
| 12 | SSSLsPLLLV | 0.300 |
| 15 | LSPLlLVSVV | 0.200 |
| 16 | SPLLlVSVVR | 0.200 |

TABLE XIX-continued

109P1D4v.7
N' terminal-B7-10-mers
Each peptide is a portion of SEQ ID NO: 15;
each start position is specified, the length
of peptide is 10 amino acids, and the end position
for each peptide is the start position plus nine.

| Pos | Subsequence | Score |
|---|---|---|
| 14 | SLSPlLLVSV | 0.200 |
| 19 | LLVSvVRVNT | 0.150 |
| 3 | RVGFlIISSS | 0.100 |
| 18 | LLLVsVVRVN | 0.020 |
| 13 | SSLSpLLLVS | 0.020 |
| 4 | VGFLiISSSS | 0.020 |
| 21 | VSVVrVNTTN | 0.020 |
| 7 | LIISsSSSLS | 0.020 |
| 17 | PLLLvSVVRV | 0.020 |
| 1 | MFRVgFLIIS | 0.020 |
| 8 | IISSsSSLSP | 0.010 |
| 2 | FRVGfLIISS | 0.002 |
| 5 | GFLIiSSSSS | 0.002 |

TABLE XX

109P1D4v.7
N' terminal-B3501-9-mers
Each peptide is a portion of SEQ ID NO: 15;
each start position is specified, the length
of peptide is 9 amino acids, and the end position
for each peptide is the start position plus eight.

| Pos | Subsequence | Score |
|---|---|---|
| 12 | SSSLSPLLL | 5.000 |
| 11 | SSSSLSPLL | 5.000 |
| 10 | SSSSSLSPL | 5.000 |
| 16 | SPLLLVSVV | 4.000 |
| 7 | LIISSSSSL | 1.000 |
| 15 | LSPLLLVSV | 1.000 |
| 13 | SSLSPLLLV | 1.000 |
| 21 | VSVVRVNTT | 0.500 |
| 3 | RVGFLIISS | 0.200 |
| 18 | LLLVSVVRV | 0.200 |
| 1 | MFRVGFLII | 0.120 |
| 19 | LLVSVVRVN | 0.100 |
| 14 | SLSPLLLVS | 0.100 |
| 20 | LVSVVRVNT | 0.100 |
| 8 | IISSSSSLS | 0.100 |

TABLE XX-continued

109P1D4v.7
N' terminal-B3501-9-mers
Each peptide is a portion of SEQ ID NO: 15;
each start position is specified, the length
of peptide is 9 amino acids, and the end position
for each peptide is the start position plus eight.

| Pos | Subsequence | Score |
|---|---|---|
| 6 | FLIISSSSS | 0.100 |
| 4 | VGFLIISSS | 0.100 |
| 9 | ISSSSSLSP | 0.050 |
| 5 | GFLIISSSS | 0.010 |
| 2 | FRVGFLIIS | 0.010 |
| 17 | PLLLVSVVR | 0.001 |

TABLE XXI

109P1D4v.7
N' terminal-B3501-10-mers
Each peptide is a portion of SEQ ID NO: 15;
each start position is specified, the length
of peptide is 10 amino acids, and the end position
for each peptide is the start position plus nine.

| Pos | Subsequence | Score |
|---|---|---|
| 9 | ISSSsSLSPL | 5.000 |
| 11 | SSSSlSPLLL | 5.000 |
| 10 | SSSSsLSPLL | 5.000 |
| 15 | LSPLlLVSVV | 1.000 |
| 6 | FLIIsSSSSL | 1.000 |
| 12 | SSSLsPLLLV | 1.000 |
| 21 | VSVVrVNTTN | 0.500 |
| 13 | SSLSpLLLVS | 0.500 |
| 16 | SPLLlVSVVR | 0.200 |
| 14 | SLSPlLLVSV | 0.200 |
| 3 | RVGFlIISSS | 0.200 |
| 18 | LLLVsVVRVN | 0.100 |
| 19 | LLVSVvRVNT | 0.100 |
| 20 | LVSVvRVNTT | 0.100 |
| 4 | VGFLiISSSS | 0.100 |
| 7 | LIISsSSSLS | 0.100 |
| 1 | MFRVgFLIIS | 0.030 |
| 17 | PLLLvSVVRV | 0.020 |
| 2 | FRVGfLIISS | 0.010 |
| 8 | IISSsSSLSP | 0.010 |
| 5 | GFLIiSSSSS | 0.010 |

TABLE VIII

109P1D4v.8 A1-9-mers
Each peptide is a portion of SEQ ID NO: 17;
each start position is specified, the length
of peptide is 9 amino acids, and the end position
for each peptide is the start position plus eight.

| Pos | Subsequence | Score |
|---|---|---|
| 7 | KKEITVQPT | 0.045 |
| 2 | FIPGLKKEI | 0.010 |
| 3 | IPGLKKEIT | 0.003 |
| 8 | KEITVQPTV | 0.001 |
| 1 | TFIPGLKKE | 0.001 |
| 4 | PGLKKEITV | 0.000 |
| 5 | GLKKEITVQ | 0.000 |
| 6 | LKKEITVQP | 0.000 |

TABLE IX

109P1D4v.8 A1-10-mers
Each peptide is a portion of SEQ ID NO: 17;
each start position is specified, the length
of peptide is 10 amino acids, and the end position
for each peptide is the start position plus nine.

| Pos | Subsequence | Score |
|---|---|---|
| 8 | KKEItVQPTV | 0.090 |
| 4 | IPGLkKEITV | 0.013 |
| 3 | FIPGlKKEIT | 0.010 |
| 2 | TFIPgLKKEI | 0.005 |
| 1 | STFIpGLKKE | 0.003 |
| 7 | LKKEiTVQPT | 0.000 |
| 9 | KEITvQPTVE | 0.000 |
| 5 | PGLKkEITVQ | 0.000 |
| 6 | GLKKeITVQP | 0.000 |

TABLE X

109P1D4v.8 A0201-9-mers
Each peptide is a portion of SEQ ID NO: 17;
each start position is specified, the length
of peptide is 9 amino acids, and the end position
for each peptide is the start position plus eight.

| Pos | Subsequence | Score |
|---|---|---|
| 2 | FIPGLKKEI | 6.599 |
| 8 | KEITVQPTV | 4.733 |
| 4 | PGLKKEITV | 0.037 |
| 3 | IPGLKKEIT | 0.017 |
| 7 | KKEITVQPT | 0.005 |
| 5 | GLKKEITVQ | 0.000 |
| 1 | TFIPGLKKE | 0.000 |
| 6 | LKKEITVQP | 0.000 |

TABLE XI

109P1D4v.8 A0201-10-mers
Each peptide is a portion of SEQ ID NO: 17;
each start position is specified, the length
of peptide is 10 amino acids, and the end position
for each peptide is the start position plus nine.

| Pos | Subsequence | Score |
|---|---|---|
| 3 | FIPGlKKEIT | 0.947 |
| 4 | IPGLkKEITV | 0.772 |
| 8 | KKEItVQPTV | 0.022 |
| 2 | TFIPgLKKEI | 0.007 |
| 7 | LKKEiTVQPT | 0.006 |
| 1 | STFIpGLKKE | 0.002 |
| 6 | GLKKeITVQP | 0.001 |
| 9 | KEITvQPTVE | 0.000 |
| 5 | PGLKkEITVQ | 0.000 |

TABLE XII

109P1D4v.8 A3-9-mers
Each peptide is a portion of SEQ ID NO: 17;
each start position is specified, the length
of peptide is 9 amino acids, and the end position
for each peptide is the start position plus eight.

| Pos | Subsequence | Score |
|---|---|---|
| 5 | GLKKEITVQ | 0.090 |
| 2 | FIPGLKKEI | 0.045 |
| 8 | KEITVQPTV | 0.004 |
| 3 | IPGLKKEIT | 0.001 |
| 7 | KKEITVQPT | 0.001 |
| 4 | PGLKKEITV | 0.000 |
| 6 | LKKEITVQP | 0.000 |
| 1 | TFIPGLKKE | 0.000 |

TABLE XIII

109P1D4v.8 A3-10-mers
Each peptide is a portion of SEQ ID NO: 17;
each start position is specified, the length
of peptide is 10 amino acids, and the end position
for each peptide is the start position plus nine.

| Pos | Subsequence | Score |
|---|---|---|
| 6 | GLKKeITVQP | 0.090 |
| 3 | FIPGlKKEIT | 0.015 |
| 4 | IPGLkKEITV | 0.004 |
| 1 | STFIpGLKKE | 0.004 |
| 8 | KKEItVQPTV | 0.001 |
| 2 | TFIPgLKKEI | 0.001 |
| 7 | LKKEiTVQPT | 0.000 |

TABLE XIII-continued

109P1D4v.8 A3-10-mers
Each peptide is a portion of SEQ ID NO: 17;
each start position is specified, the length
of peptide is 10 amino acids, and the end position
for each peptide is the start position plus nine.

| Pos | Subsequence | Score |
|---|---|---|
| 9 | KEITvQPTVE | 0.000 |
| 5 | PGLKkEITVQ | 0.000 |

TABLE XIV

109P1D4v.8 A1101-9-mers
Each peptide is a portion of SEQ ID NO: 17;
each start position is specified, the length
of peptide is 9 amino acids, and the end position
for each peptide is the start position plus eight.

| Pos | Subsequence | Score |
|---|---|---|
| 8 | KEITVQPTV | 0.003 |
| 2 | FIPGLKKEI | 0.002 |
| 5 | GLKKEITVQ | 0.001 |
| 3 | IPGLKKEIT | 0.000 |
| 1 | TFIPGLKKE | 0.000 |
| 4 | PGLKKEITV | 0.000 |
| 7 | KKEITVQPT | 0.000 |
| 6 | LKKEITVQP | 0.000 |

TABLE XV

109P1D4v.8 A1101-10-mers
Each peptide is a portion of SEQ ID NO: 17;
each start position is specified, the length
of peptide is 10 amino acids, and the end position
for each peptide is the start position plus nine.

| Pos | Subsequence | Score |
|---|---|---|
| 4 | IPGLkKEITV | 0.004 |
| 2 | TFIPgLKKEI | 0.002 |
| 6 | GLKKeITVQP | 0.001 |
| 1 | STFIpGLKKE | 0.001 |
| 8 | KKEItVQPTV | 0.001 |
| 3 | FIPGlKKEIT | 0.000 |
| 9 | KEITvQPTVE | 0.000 |
| 7 | LKKEiTVQPT | 0.000 |
| 5 | PGLKkEITVQ | 0.000 |

TABLE XVI

109P1D4v.8
A24-9-mers
Each peptide is a portion of SEQ
ID NO: 17; each start position is
specified, the length of peptide is
9 amino acids, and the end
position for each peptide is the
start posifion plus eight.

| Pos | Subsequence | Score |
|---|---|---|
| 2 | FIPGLKKEI | 1.980 |
| 3 | IPGLKKEIT | 0.100 |
| 1 | TFIPGLKKE | 0.099 |
| 8 | KEITVQPTV | 0.042 |
| 7 | KKEITVQPT | 0.036 |
| 4 | PGLKKEITV | 0.015 |
| 5 | GLKKEITVQ | 0.010 |
| 6 | LKKEITVQP | 0.002 |

TABLE XVII

109P1D4v.8
A24-10-mers
Each peptide isa portion of
SEQ ID NO: 17; each start
position is specified, the length
of peptide is 10 amino acids,
and the end position for each
peptide is the start position plus
nine.

| Pos | Subsequence | Score |
|---|---|---|
| 2 | TFIPgLKKEI | 11.880 |
| 3 | FIPGIKKEIT | 0.150 |
| 4 | IPGLkKEITV | 0.100 |
| 8 | KKEItVQPTV | 0.042 |
| 7 | LKKEiTVQPT | 0.014 |
| 6 | GLKKeITVQP | 0.014 |
| 1 | STFIpGLKKE | 0.011 |
| 9 | KEITvQPTVE | 0.003 |
| 5 | PGLKkEITVQ | 0.002 |

TABLE XVIII

109P1D4v.8
B7-9-mers
Each peptide is a portion of SEQ
ID NO: 17; each start position is
specified, the length of peptide is
9 amino acids, and the end
position for each peptide is the
start position plus eight.

| Pos | Subsequence | Score |
|---|---|---|
| 3 | IPGLKKEIT | 2.000 |
| 2 | FIPGLKKEI | 0.400 |

TABLE XVIII-continued

109P1D4v.8
B7-9-mers
Each peptide is a portion of SEQ
ID NO: 17; each start position is
specified, the length of peptide is
9 amino acids, and the end
position for each peptide is the
start position plus eight.

| Pos | Subsequence | Score |
|---|---|---|
| 8 | KEITVQPTV | 0.020 |
| 4 | PGLKKEITV | 0.020 |
| 5 | GLKKEITVQ | 0.010 |
| 7 | KKEITVQPT | 0.003 |
| 6 | LKKEITVQP | 0.001 |
| 1 | TFIPGLKKE | 0.001 |

TABLE XIX

109P1D4v.8
B7-10-mers
Each peptide is a portion of SEQ
ID NO: 17; each start position is
specified, the length of peptide is
10 amino acids, and the end
position for each peptide is the
start position plus nine.

| Pos | Subsequence | Score |
|---|---|---|
| 4 | IPGLkKEITV | 4.000 |
| 3 | FIPGIKKEIT | 0.100 |
| 2 | TFIPgLKKEI | 0.040 |
| 7 | LKKEiTVQPT | 0.010 |
| 1 | STFIpGLKKE | 0.010 |
| 6 | GLKKeITVQP | 0.010 |
| 8 | KKEItVQPTV | 0.006 |
| 9 | KEITvQPTVE | 0.001 |
| 5 | PGLKkEITVQ | 0.001 |

TABLE XX

109P1D4v.8
B3501-9-mers
Each peptide is a portion of SEQ
ID NO: 17; each start position is
specified, the length of peptide is
9 amino acids, and the end
position for each peptide is the
start position plus eight.

| Pos | Subsequence | Score |
|---|---|---|
| 3 | IPGLKKEIT | 2.000 |
| 2 | FIPGLKKEI | 0.400 |
| 5 | GLKKEITVQ | 0.045 |
| 8 | KEITVQPTV | 0.040 |

TABLE XX-continued

109P1D4v.8
B3501-9-mers
Each peptide is a portion of SEQ ID NO: 17; each start position is specified, the length of peptide is 9 amino acids, and the end position for each peptide is the start position plus eight.

| Pos | Subsequence | Score |
|---|---|---|
| 4 | PGLKKEITV | 0.020 |
| 6 | LKKEITVQP | 0.006 |
| 7 | KKEITVQPT | 0.006 |
| 1 | TFIPGLKKE | 0.001 |

TABLE XXI

109P1D4V.8
B3501-10-mers
Each peptide is a portion of SEQ ID NO: 17; each start position is specified, the length of peptide is 10 amino acids, and the end position for each peptide is the start position plus nine.

| Pos | Subsequence | Score |
|---|---|---|
| 4 | IPGLkKEITV | 4.000 |
| 3 | FIPGIKKEIT | 0.100 |
| 7 | LKKEiTVQPT | 0.060 |
| 2 | TFIPgLKKEI | 0.040 |
| 6 | GLKKeUTVQP | 0.030 |
| 8 | DDEItVQPTV | 0.012 |
| 1 | STFIpGLKKE | 0.010 |
| 9 | KEITvQPTVE | 0.002 |
| 5 | PGLKkEITVQ | 0.002 |

TABLE XXII

109P1D4v.1
A1-9-mers
Each peptide is a portion of SEQ ID NO: 3; each start position is specified, the length of peptide is 9 amino acids, and the end position for each peptide is the start position plus eight.

| | | |
|---|---|---|
| 911 | LEEQTMGKY | 27 |
| 59 | TAMQFKLVY | 22 |
| 570 | FIHNEYNFY | 22 |
| 807 | TSDYVKILV | 22 |
| 20 | HSGAQEKNY | 21 |

TABLE XXII-continued

109P1D4v.1
A1-9-mers
Each peptide is a portion of SEQ ID NO: 3; each start position is specified, the length of peptide is 9 amino acids, and the end position for each peptide is the start position plus eight.

| | | |
|---|---|---|
| 418 | LETAAYLDY | 21 |
| 495 | SGPNAKINY | 21 |
| 594 | VTDPDYGDN | 21 |
| 985 | SSDPYSVSD | 21 |
| 364 | VNDTVVLSE | 20 |
| 370 | LSENIPLNT | 20 |
| 674 | IVPPSNCSY | 20 |
| 789 | STEAPVTPN | 20 |
| 168 | VGINGVQNY | 19 |
| 351 | NVPSIDIRY | 19 |
| 741 | VTDLGLHRV | 19 |
| 931 | DSPDLARHY | 19 |
| 981 | CSSSSSDPY | 19 |
| 116 | PDEIFRLVK | 18 |
| 150 | ENSAINSKY | 18 |
| 329 | ASDGGLMPA | 18 |
| 345 | VTDVNDNVP | 18 |
| 991 | VSDCGYPVT | 18 |
| 221 | VEDGGFPQR | 17 |
| 239 | VTDTNDNHP | 17 |
| 251 | ETEIEVSIP | 17 |
| 273 | ATOADIGEN | 17 |
| 354 | SIDIRYIVN | 17 |
| 385 | VTDKDADHN | 17 |
| 399 | FTDHEIPFR | 17 |
| 528 | LDREKEDKY | 17 |
| 587 | SPVFTHNEY | 17 |
| 727 | DQETGNITL | 17 |
| 929 | KPDSPDLAR | 17 |
| 1008 | HTRPVGIQV | 17 |
| 34 | MPENVLIGD | 16 |
| 78 | EEDTGEIFT | 16 |
| 90 | RIDREKLCA | 16 |
| 109 | EVEVAILPD | 16 |

TABLE XXII-continued

109P1D4v.1
A1-9-mers
Each peptide is a portion of SEQ ID NO: 3; each start position is specified, the length of peptide is 9 amino acids, and the end position for each peptide is the start position plus eight.

| | | |
|---|---|---|
| 132 | INDNAPLFP | 16 |
| 163 | AVDPDVGIN | 16 |
| 401 | DHEIPFRLR | 16 |
| 531 | EKEDKYLFT | 16 |
| 631 | FDREKQESY | 16 |
| 738 | KCDVTDLGL | 16 |
| 797 | NTEIADVSS | 16 |
| 802 | DVSSPTSDY | 16 |
| 897 | DSDGNRVTL | 16 |
| 69 | TGDVPLIRI | 15 |
| 100 | IPRDEHCFY | 15 |
| 115 | LPDEIFRLV | 15 |
| 207 | LDREEKDTY | 15 |
| 415 | QELLETAAY | 15 |
| 423 | YLDYESTKE | 15 |
| 424 | LDYESTKEY | 15 |
| 428 | STKEYAIKL | 15 |
| 591 | LITVTDPDY | 15 |
| 634 | EKQESYTFY | 15 |
| 645 | AEDGGRVSR | 15 |
| 688 | STNPGTVVF | 15 |
| 705 | TGMNAEVRY | 15 |
| 988 | PYSVSDCGY | 15 |
| 68 | KTGDVPLIR | 14 |
| 148 | IPENSAINS | 14 |
| 211 | EKDTYVMKV | 14 |
| 278 | IGENAKIHF | 14 |
| 311 | IKEPLDREE | 14 |
| 317 | REETPNHKL | 14 |
| 319 | EIPNHKLLV | 14 |
| 411 | VESNQFLLE | 14 |
| 514 | SLDCRTGML | 14 |
| 542 | AKDNGVPPL | 14 |
| 572 | HNEYNFYVP | 14 |

TABLE XXII-continued

109P1D4v.1
A1-9-mers
Each peptide is a portion of SEQ ID NO: 3; each start position is specified, the length of peptide is 9 amino acids, and the end position for each peptide is the start position plus eight.

| | | |
|---|---|---|
| 612 | ENDDFTIDS | 14 |
| 644 | KAEDGGRVS | 14 |
| 668 | DNKPVFIVP | 14 |
| 681 | SYELVLPST | 14 |
| 720 | TRDLFAIDQ | 14 |
| 758 | QPDSLFSVV | 14 |
| 779 | ATLINELVR | 14 |
| 851 | NSEWATPNP | 14 |
| 904 | TLDLPIDLE | 14 |
| 967 | PLDNTFVAC | 14 |

TABLE XXIII

109P1D4v.1
A0201-9-mers
Each peptide is a portion of SEQ ID NO: 3; each start position is specified, the length of peptide is 9 amino acids, and the end position for each peptide is the start position plus eight.

| | | |
|---|---|---|
| 114 | ILPDEIFRL | 27 |
| 416 | FLLETAAYL | 27 |
| 43 | LLKDLNLSL | 26 |
| 333 | GLMPABAMV | 26 |
| 520 | GMLTWKKLL | 26 |
| 39 | LIGDLLKDL | 25 |
| 294 | NIARRLFHL | 24 |
| 514 | SLDCRTGML | 24 |
| 817 | AVAGTITVV | 24 |
| 880 | NLLLNFVTI | 24 |
| 64 | KLVYKTGDV | 23 |
| 231 | STAILQVSV | 23 |
| 307 | GLITIKEPL | 23 |
| 375 | PLNTKIALI | 23 |
| 539 | TILAKDNGV | 23 |
| 745 | GLHRVLVKA | 23 |

TABLE XXIII-continued

109P1D4v.1
A0201-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 810 | YVKILVAAV | 23 |
| 813 | ILVAAVAGT | 23 |
| 38 | VLIGDLLKD | 22 |
| 741 | VTDLGLHRV | 22 |
| 816 | AAVAGTITV | 22 |
| 9 | IFAVLLACV | 21 |
| 76 | RIEEDTGEI | 21 |
| 124 | KIRFLIEDI | 21 |
| 152 | SAINSKYTL | 21 |
| 301 | HLNATTGLI | 21 |
| 356 | DIRYIVNPV | 21 |
| 360 | IVNPVNDTV | 21 |
| 536 | YLFTILAKD | 21 |
| 743 | DLGLHRVLV | 21 |
| 820 | GTITVVVVI | 21 |
| 825 | IVVVIFITA | 21 |
| 999 | TTFEVPVSV | 21 |
| 50 | SLIPNKSLT | 20 |
| 127 | FLIEDINDN | 20 |
| 234 | ILQVSVTDT | 20 |
| 270 | QLHATDADI | 20 |
| 298 | RLFHLNATT | 20 |
| 334 | LMPARAMVL | 20 |
| 337 | ARAMVLVNV | 20 |
| 340 | MVLVNVTDV | 20 |
| 347 | DVNDNVPSI | 20 |
| 359 | YIVNPVNDT | 20 |
| 428 | STKEYAIKL | 20 |
| 546 | GVPPLTSNV | 20 |
| 550 | LTSNVTVFV | 20 |
| 656 | SAKVTINVV | 20 |
| 658 | KVTINVVDV | 20 |
| 715 | IVGGNTRDL | 20 |
| 725 | AIDQETGNI | 20 |
| 777 | TNATLINEL | 20 |
| 781 | LINELVRKS | 20 |
| 826 | VVIFITAVV | 20 |
| 6 | GTYIFAVLL | 19 |
| 12 | VLLACVVFH | 19 |
| 22 | GAQEKNYTI | 19 |
| 135 | NAPLFPATV | 19 |
| 162 | 1MVDPDVGI | 19 |
| 303 | NATTGLITI | 19 |
| 326 | LVLASDGGL | 19 |
| 377 | NTKIALITV | 19 |
| 438 | AADAGKPPL | 19 |
| 503 | YLLGPDAPP | 19 |
| 542 | AKDNGVPPL | 19 |
| 583 | LPRHGTVGL | 19 |
| 616 | FTIDSQTGV | 19 |
| 818 | VAGTITVVV | 19 |
| 881 | LLLNFVTIE | 19 |
| 903 | VTLDLPIDL | 19 |
| 914 | QTMGKYNWV | 19 |
| 3 | LLSGTYIFA | 18 |
| 4 | LSGTYIFAV | 18 |
| 13 | LLACVVFHS | 18 |
| 51 | LIPNKSLTT | 18 |
| 95 | KLCAGIPRD | 18 |
| 120 | FRLVKIRFL | 18 |
| 121 | RLVKIRFLI | 18 |
| 213 | DTYVMKVKV | 18 |
| 276 | ADIGENAKI | 18 |
| 283 | KIHFSFSNL | 18 |
| 369 | VLSENIPLN | 18 |
| 381 | ALITVTDKD | 18 |
| 403 | EIPFRLRPV | 18 |
| 480 | SPGIQLTKV | 18 |
| 496 | GPNAKINYL | 18 |

TABLE XXIII-continued

109P1D4v.1
A0201-9-mers
Each peptide is a portion of SEQ ID NO: 3; each start position is specified, the length of peptide is 9 amino acids, and the end position for each peptide is the start position plus eight.

| | | |
|---|---|---|
| 609 | ILDENDDFT | 18 |
| 617 | TIDSQTGVI | 18 |
| 693 | TVVFQVIAV | 18 |
| 733 | ITLMEKCDV | 18 |
| 734 | TLMEKCDVT | 18 |
| 748 | RVLVKANDL | 18 |
| 757 | GQPDSLFSV | 18 |
| 762 | LFSWIVNL | 18 |
| 780 | TLINELVRK | 18 |
| 814 | LVAAVAGTI | 18 |
| 822 | ITVVVIFI | 18 |
| 955 | PLNSKHHII | 18 |
| 958 | SKHHIIQEL | 18 |
| 990 | SVSDCGYPV | 18 |
| 8 | YIFAVLLAC | 17 |
| 57 | LTTAAAFKL | 17 |
| 88 | GARIDREKL | 17 |
| 143 | VINISIPEN | 17 |
| 156 | SKYTLPAAV | 17 |
| 165 | DPDVGINGV | 17 |
| 179 | IKSQNIFGL | 17 |
| 256 | VSIPENAPV | 17 |
| 320 | TPNHKLLVL | 17 |
| 327 | VLASDGGLM | 17 |
| 368 | VVLSENIPL | 17 |
| 379 | KIALITVTD | 17 |
| 482 | GIQLTKVSA | 17 |
| 493 | ADSGPNAKI | 17 |
| 586 | HGTVGLITV | 17 |
| 685 | VLPSTNPGT | 17 |
| 761 | SLFSVVIVN | 17 |
| 764 | SVVIVNLFV | 17 |
| 795 | TPNTEIADV | 17 |
| 819 | AGTITVVVV | 17 |
| 965 | ELPLDNTFV | 17 |
| 1006 | SVHTRPVGI | 17 |
| 2 | DLLSGTYIF | 16 |
| 10 | FAVLLACVV | 16 |
| 42 | DLLKDLNLS | 16 |
| 49 | LSLIPNKSL | 16 |
| 60 | AMQFKLVYK | 16 |
| 67 | YKTGDVPLI | 16 |
| 83 | EIFTTGARI | 16 |
| 107 | FYEVEVAIL | 16 |
| 117 | DEIFRLVKI | 16 |
| 145 | NISIPENSA | 16 |
| 197 | KMPQLIVQK | 16 |
| 233 | AILQVSVTD | 16 |
| 290 | NLVSNIARR | 16 |
| 291 | LVSNIARRL | 16 |
| 300 | FHLNATTGL | 16 |
| 432 | YAIKLLAAD | 16 |
| 433 | AIKLLAADA | 16 |
| 435 | KLLAADAGK | 16 |
| 436 | LLAADAGKP | 16 |
| 532 | KEDKYLFTI | 16 |
| 553 | NVTVFVSII | 16 |
| 587 | GTVGLITVT | 16 |
| 599 | YGDNSAVTL | 16 |
| 602 | NSAVTLSIL | 16 |
| 655 | SSAKVTINV | 16 |
| 667 | NDNKPVFIV | 16 |
| 722 | DLFAIDQET | 16 |
| 754 | NDLGQPDSL | 16 |
| 760 | DSLFSVVIV | 16 |
| 771 | FVNESVTNA | 16 |
| 806 | PTSDYVKIL | 16 |
| 882 | LLNFVTIEE | 16 |
| 934 | DLARHYKSA | 16 |

TABLE XXIII-continued

109P1D4v.1
A0201-9-mers
Each peptide is a portion
of SEQ ID NO: 3; each
start position is
specified, the length of
peptide is 9 amino acids,
and the end position for
each peptide is the start
position plus eight.

| Start | Peptide | Score |
|---|---|---|
| 1008 | HTRPVGIQV | 16 |
| 41 | GDLLKDLNL | 15 |
| 58 | TTAMQFKLV | 15 |
| 146 | ISIPENSAI | 15 |
| 160 | LPAAVDPDV | 15 |
| 170 | INGVQNYEL | 15 |
| 181 | SQNIFGLDV | 15 |
| 182 | QNIFGLDVI | 15 |
| 229 | RSSTAILQV | 15 |
| 263 | PVGTSVTQL | 15 |
| 284 | IHFSFSNLV | 15 |
| 287 | SFSNLVSNI | 15 |
| 338 | RAMVLVNVT | 15 |
| 374 | IPLNTKIAL | 15 |
| 396 | VTCFTDHEI | 15 |
| 448 | QSAMLFIKV | 15 |
| 450 | AMLFIKVKD | 15 |
| 451 | MLFIKVKDE | 15 |
| 504 | LLGPDAPPE | 15 |
| 517 | CRTGMLTVV | 15 |
| 590 | GLITVTDPD | 15 |
| 624 | VIRPNISFD | 15 |
| 643 | VKAEDGGRV | 15 |
| 651 | VSRSSSAKV | 15 |
| 688 | STNPGTVVF | 15 |
| 703 | NDTGMNAEV | 15 |
| 707 | MNAEVRYSI | 15 |
| 742 | TDLGLHRVL | 15 |
| 767 | IVNLFVNES | 15 |
| 769 | NLFVNESVT | 15 |
| 875 | KHSPKNLLL | 15 |
| 897 | DSDGNRVTL | 15 |
| 904 | TLDLPIDLE | 15 |
| 906 | DLPIDLEEQ | 15 |
| 961 | HIIQELPLD | 15 |
| 970 | NTFVACDSI | 15 |
| 983 | SSSSDPYSV | 15 |
| 995 | GYPVTTFEV | 15 |
| 44 | LKDLNLSLI | 14 |
| 46 | DLNLSLIPN | 14 |
| 66 | VVKTGDVPL | 14 |
| 106 | CFYEVEVAI | 14 |
| 111 | EVAILPDEI | 14 |
| 113 | AILPDEIFR | 14 |
| 115 | LPDEIFRLV | 14 |
| 128 | LIEDINQNA | 14 |
| 137 | PLFPATVIN | 14 |
| 138 | LFPATVINI | 14 |
| 147 | SIPENSAIN | 14 |
| 159 | TLPAAVDPD | 14 |
| 183 | NIFGLDVIE | 14 |
| 211 | EKDTYVMKV | 14 |
| 232 | TAILQVSVT | 14 |
| 248 | VFKETEIEV | 14 |
| 250 | KETEIEVSI | 14 |
| 310 | TIKEPLORE | 14 |
| 324 | KLLVLASDG | 14 |
| 329 | ASDGGLMPA | 14 |
| 335 | MPARAMVLV | 14 |
| 339 | AMVLVNVTD | 14 |
| 344 | NVTDVNDNV | 14 |
| 362 | NPVNDTVVL | 14 |
| 388 | KDADHNGRV | 14 |
| 412 | FSNQFLLET | 14 |
| 465 | VFTQSFVTV | 14 |
| 483 | IQLTKVSAM | 14 |
| 500 | KINYLLGPD | 14 |
| 507 | PDAPPEFSL | 14 |
| 516 | DCRTGMLVV | 14 |

TABLE XXIII-continued

109P1D4v.1
A0201-9-mers
Each peptide is a portion of SEQ ID NO: 3; each start position is specified, the length of peptide is 9 amino acids, and the end position for each peptide is the start position plus eight.

| | | |
|---|---|---|
| 540 | ILAKDNGVP | 14 |
| 552 | SNVTVFVSI | 14 |
| 571 | THNEYNFYV | 14 |
| 678 | SNCSYELVL | 14 |
| 686 | LPSTNPGTV | 14 |
| 690 | NPGTVVFQV | 14 |
| 706 | GMNAEVRYS | 14 |
| 714 | SIVGGNTRD | 14 |
| 768 | VNLFVNESV | 14 |
| 773 | NESVTNATL | 14 |
| 784 | ELVRKSTEA | 14 |
| 812 | KILVAAVAG | 14 |
| 878 | PKNLLLNFV | 14 |
| 895 | DVDSDGNRV | 14 |
| 948 | FQIQPETPL | 14 |
| 962 | IIQELPLDN | 14 |

TABLE XXIV

109P1D4v.1 A0203-9-mers

No Results Found.

TABLE XXV

109P1D4v.1-A3-9-mers
Each peptide is a portion of SEQ ID NO: 3; each start position is specified, the length of peptide is 9 amino acids, and the end position for each peptide is the start position plus eight.

| | | |
|---|---|---|
| 650 | RVSRSSSAK | 31 |
| 435 | KLLAADAGK | 30 |
| 11 | AVLLACVVF | 28 |
| 37 | NVLIGDLLK | 28 |
| 780 | TLINELVRK | 28 |
| 527 | KLDREKEDK | 26 |
| 172 | GVQNYELIK | 24 |

TABLE XXV-continued

109P1D4v.1-A3-9-mers
Each peptide is a portion of SEQ ID NO: 3; each start position is specified, the length of peptide is 9 amino acids, and the end position for each peptide is the start position plus eight.

| | | |
|---|---|---|
| 407 | RLRPVFSNQ | 24 |
| 827 | VIFITAVVR | 24 |
| 839 | APHLKAAQK | 24 |
| 422 | AYLDYESTK | 23 |
| 674 | IVPPSNCSY | 23 |
| 841 | HLKAAQKNK | 23 |
| 972 | FVACDSISK | 23 |
| 12 | VLLACVVFH | 22 |
| 233 | AILQVSVTD | 22 |
| 518 | RTGMLTVVK | 22 |
| 623 | GVIRPNISF | 22 |
| 662 | NVVDVNDNK | 22 |
| 814 | LVAAVAGTI | 22 |
| 833 | VVRCRQAPH | 22 |
| 910 | ELEEQTMGK | 22 |
| 56 | SLTTAMQFK | 21 |
| 65 | LVYKTGDVP | 21 |
| 167 | DVGINGVQN | 21 |
| 298 | RLFHLNATT | 21 |
| 324 | KLLVLASDG | 21 |
| 379 | KIALITVTD | 21 |
| 524 | VVKKLDREK | 21 |
| 582 | NLPRHGTVG | 21 |
| 740 | DVTDLGLHR | 21 |
| 744 | LGLHRVLVK | 21 |
| 812 | KILVAAVAG | 21 |
| 817 | AVAGTITVV | 21 |
| 880 | NLLLNFVTI | 21 |
| 921 | WVTTPTTFK | 21 |
| 50 | SLIPNKSLT | 20 |
| 113 | AILPDEIFR | 20 |
| 197 | KMPQLIVQK | 20 |
| 360 | IVNPVNDTV | 20 |
| 748 | RVLVKANDL | 20 |

TABLE XXV-continued

109P1D4v.1-A3-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 826 | VVIFITAVV | 20 |
| 17 | VVFHSGAQE | 19 |
| 116 | PDEIFRLVK | 19 |
| 189 | VIETPEGDK | 19 |
| 218 | KVKVEDGGF | 19 |
| 220 | KVEDGGFPQ | 19 |
| 384 | TVTDKDADH | 19 |
| 416 | FLLETAAYL | 19 |
| 433 | AIKLLAADA | 19 |
| 479 | NSPGIQLTK | 19 |
| 535 | KYLFTILAK | 19 |
| 549 | PLTSNVTVF | 19 |
| 588 | TVGLITVTD | 19 |
| 665 | DVNDNKPVF | 19 |
| 802 | DVSSPTSDY | 19 |
| 864 | MIMMKKKKK | 19 |
| 2 | DLLSGTYIF | 18 |
| 38 | VLIGDLLKD | 18 |
| 60 | AMQFKLVYK | 18 |
| 90 | RIDREKLCA | 18 |
| 212 | KDTYVMKVK | 18 |
| 267 | SVTQLHATD | 18 |
| 333 | GLMPARAMV | 18 |
| 445 | PLNQSAMLF | 18 |
| 487 | DVSAMDADS | 18 |
| 540 | ILAKDNGVP | 18 |
| 642 | YVKAEDGGR | 18 |
| 645 | KVTINVVDV | 18 |
| 658 | KVTINVVDV | 18 |
| 688 | STNPGTVVF | 18 |
| 694 | VVFQVIAVD | 18 |
| 697 | QVQAVDNDT | 18 |
| 745 | GLHRVLVKA | 18 |
| 832 | AVVRCRQAP | 18 |
| 835 | RCRQAPHLK | 18 |
| 871 | KKKKKHSPK | 18 |
| 1002 | EVPVSVHTR | 18 |
| 1006 | SVHTRPVGI | 18 |
| 43 | LLKDLNLSL | 17 |
| 51 | LIPNKSLTT | 17 |
| 95 | KLQAGIPRD | 17 |
| 122 | LVKIRFLIE | 17 |
| 137 | PLFPATVIN | 17 |
| 163 | AVDPDVGIN | 17 |
| 177 | ELIKSQNIF | 17 |
| 210 | EEKDTYVMK | 17 |
| 257 | SIPENAPVG | 17 |
| 270 | QLHATDADI | 17 |
| 290 | NLVSNIARR | 17 |
| 381 | ALITVTDKD | 17 |
| 436 | LLAADAGKP | 17 |
| 484 | QLTKVSAMD | 17 |
| 503 | YLLGPDAPP | 17 |
| 604 | AVTLSILDE | 17 |
| 624 | VIRPNISFD | 17 |
| 710 | EVRYSIVGG | 17 |
| 755 | DLGQPDSLF | 17 |
| 765 | VVIVNLFVN | 17 |
| 769 | NLFVNESVT | 17 |
| 779 | ATLINELVR | 17 |
| 813 | ILVAAVAGT | 17 |
| 821 | TITVVVVIF | 17 |
| 1013 | GIQVSNTTF | 17 |
| 55 | KSLTTAMQF | 16 |
| 73 | PLIRIEEDT | 16 |
| 74 | LIRIEEDTG | 16 |
| 131 | DINQNAPLE | 16 |
| 201 | LIVQKELDR | 16 |
| 238 | SVTDTNDNH | 16 |

TABLE XXV-continued

109P1D4v.1-A3-9-mers
Each peptide is a portion of SEQ ID NO: 3; each start position is specified, the length of peptide is 9 amino acids, and the end position for each peptide is the start position plus eight.

| | | |
|---|---|---|
| 242 | TNDNHPVFK | 16 |
| 277 | DIGENAKIH | 16 |
| 293 | SNIARRLFH | 16 |
| 304 | ATTGLITIK | 16 |
| 341 | VLVNVTDVN | 16 |
| 351 | NVPSIDIRY | 16 |
| 354 | SIDIRYIVN | 16 |
| 371 | SENIPLNTK | 16 |
| 380 | IALITVTDK | 16 |
| 449 | SAMLFIKVK | 16 |
| 504 | LLGPDAPPE | 16 |
| 546 | GVPPLTSNV | 16 |
| 608 | SILDENDDF | 16 |
| 636 | QESYTFYVK | 16 |
| 700 | AVDNDTGMN | 16 |
| 713 | YSIVGGNTR | 16 |
| 734 | TLMEKCDVT | 16 |
| 743 | DLGLHRVLV | 16 |
| 750 | LVKANDLGQ | 16 |
| 761 | SLFSVVIVN | 16 |
| 764 | SVVIVNLFV | 16 |
| 810 | YVKILVAAV | 16 |
| 934 | DLARHYKSA | 16 |
| 967 | PLDNTFVAC | 16 |

TABLE XXVI

109P1D4v.1 A26-9-mers
Each peptide is a portion of SEQ ID NO: 3; each start position is specified, the length of peptide is 9 amino acids, and the end position for each peptide is the start position plus eight.

| | | |
|---|---|---|
| 802 | DVSSPTSDY | 30 |
| 665 | DVNDNKPVF | 28 |

TABLE XXVI-continued

109P1D4v.1 A26-9-mers
Each peptide is a portion of SEQ ID NO: 3; each start position is specified, the length of peptide is 9 amino acids, and the end position for each peptide is the start position plus eight.

| | | |
|---|---|---|
| 241 | DTNDNHPVF | 26 |
| 36 | ENVLIGDLL | 25 |
| 109 | EVEVAILPD | 25 |
| 347 | DVNDNVPSI | 25 |
| 1002 | EVPVSVHTR | 25 |
| 150 | ENSAINSKY | 24 |
| 188 | DVIETPEGD | 24 |
| 351 | NVPSIDIRY | 24 |
| 410 | PVFSNQFLL | 24 |
| 623 | GVIRPNISF | 24 |
| 710 | EVRYSIVGG | 24 |
| 118 | EIFRLVKIR | 23 |
| 251 | ETEIEVSIP | 23 |
| 263 | PVGTSVTQL | 23 |
| 740 | DVTDLGLHR | 23 |
| 130 | EDINDNAPL | 22 |
| 131 | DINDNAPLF | 22 |
| 177 | ELIKSQNIF | 22 |
| 419 | ETAAYLDYE | 22 |
| 477 | ENNSPGIQL | 22 |
| 634 | EKQESYTFY | 22 |
| 674 | IVPPSNCSY | 22 |
| 729 | ETGNITLME | 22 |
| 71 | DVPLIRIEE | 21 |
| 80 | DTGEIFTTG | 21 |
| 111 | EVAILPOEI | 21 |
| 167 | DVGINGVQN | 21 |
| 191 | ETPEGDKMP | 21 |
| 255 | EVSIPENAP | 21 |
| 280 | ENAKIHFSF | 21 |
| 318 | EETPNHKLL | 21 |
| 366 | DTVVLSENI | 21 |
| 428 | STKEYAIKL | 21 |
| 693 | TVVFQVIAV | 21 |

TABLE XXVI-continued

109P1D4v.1
A26-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 806 | PTSDYVKIL | 21 |
| 993 | DCGYPVTTF | 21 |
| 291 | LVSNIARRL | 20 |
| 368 | VVLSENIPL | 20 |
| 391 | DHNGRVTCF | 20 |
| 523 | TVVKKLDRE | 20 |
| 555 | TVFVSIIDQ | 20 |
| 895 | DVDSDGNRV | 20 |
| 931 | DSPDLARHY | 20 |
| 83 | EIFTTGARI | 19 |
| 218 | KVKVEDGGF | 19 |
| 319 | ETPNHKLLV | 19 |
| 326 | LVLASDGGL | 19 |
| 533 | EDKYLFTIL | 19 |
| 715 | IVGGNTRDL | 19 |
| 748 | RVLVKANDL | 19 |
| 765 | VVIVNLFVN | 19 |
| 809 | DYVKILVAA | 19 |
| 823 | TVVVIFIT | 19 |
| 825 | VVVIFITAV | 19 |
| 903 | VTLDLPIDL | 19 |
| 953 | ETPLNSKHH | 19 |
| 11 | AVLLACVVF | 18 |
| 33 | EMPENVLIG | 18 |
| 39 | LIGDLLKDL | 18 |
| 57 | LTTAMQFKL | 18 |
| 141 | ATVINISIP | 18 |
| 142 | TVINISIPE | 18 |
| 168 | VGINGVQNY | 18 |
| 253 | EIEVSIPEN | 18 |
| 356 | DIRYIVNPV | 18 |
| 403 | EIPFRLRPV | 18 |
| 458 | DENDNAPVF | 18 |
| 562 | DQNDNSPVF | 18 |

TABLE XXVI-continued

109P1D4v.1
A26-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 570 | FTHNEYNFY | 18 |
| 688 | STNPGTVVF | 18 |
| 694 | VVFQVIAVD | 18 |
| 727 | DQETGNITL | 18 |
| 763 | FSVVIVNLF | 18 |
| 821 | TITVVVVIF | 18 |
| 824 | VVVVIFITA | 18 |
| 890 | ETKADDVDS | 18 |
| 897 | DSDGNRVTL | 18 |
| 2 | DLLSGTYIF | 17 |
| 117 | DEIFRLVKI | 17 |
| 213 | DTYVMKVKV | 17 |
| 350 | DNVPSIDIR | 17 |
| 372 | ENIPLNTKI | 17 |
| 431 | EYAIKLLAA | 17 |
| 578 | YVPENLPRH | 17 |
| 587 | GTVGLITVT | 17 |
| 704 | DTGMNAEVR | 17 |
| 755 | DLGQPDSLF | 17 |
| 822 | ITVVVIFI | 17 |
| 899 | DGNRVTLDL | 17 |
| 6 | GTYIFAVLL | 16 |
| 16 | CVVFHSGAQ | 16 |
| 17 | VVFHSGAQE | 16 |
| 79 | EDTGEIFTT | 16 |
| 163 | AVDPDVGIN | 16 |
| 294 | NIARRLFHL | 16 |
| 529 | DREKEDKYL | 16 |
| 553 | NVTVFVSII | 16 |
| 604 | AVTLSILDE | 16 |
| 614 | DDFTIDSQT | 16 |
| 658 | KVTINVVDV | 16 |
| 659 | VTINVVDVN | 16 |
| 764 | SVVIVNLFV | 16 |

TABLE XXVI-continued

109P1D4v.1
A26-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 771 | FVNESVTNA | 16 |
| 799 | EIADVSSPT | 16 |
| 810 | YVKILVAAV | 16 |
| 820 | GTITVVVVI | 16 |
| 826 | VVIFITAVV | 16 |
| 976 | DSISKCSSS | 16 |
| 999 | TTFEVPVSV | 16 |
| 211 | EKDTYVMKV | 15 |
| 277 | DIGENAKIH | 15 |
| 320 | TPNHKLLVL | 15 |
| 340 | MVLVNVTDV | 15 |
| 363 | PVNDTVVLS | 15 |
| 367 | TVVLSENIP | 15 |
| 470 | FVTVSIPEN | 15 |
| 471 | VTVSIPENN | 15 |
| 549 | PLTSNVTVF | 15 |
| 567 | SPVFTHNEY | 15 |
| 591 | LITVTDPDY | 15 |
| 605 | VTLSILDEN | 15 |
| 646 | EDGGRVSRS | 15 |
| 662 | NVVDVNDNK | 15 |
| 671 | PVFIVPPSN | 15 |
| 774 | ESVTNATLI | 15 |
| 784 | ELVRKSTEA | 15 |
| 832 | AVVRCRQAP | 15 |
| 860 | ENRQMIMMK | 15 |
| 877 | SPKNLLLNF | 15 |
| 886 | VTIEETKAD | 15 |
| 902 | RVTLOLPID | 15 |
| 958 | SKHHIIQEL | 15 |
| 1011 | PVGIQVSNT | 15 |

TABLE XXVII

109P1D4
v.1-B0702-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 583 | LPRHGTVGL | 25 |
| 362 | NPVNDTVVL | 24 |
| 136 | APLFPATVI | 23 |
| 320 | TPNHKLLVL | 23 |
| 374 | IPLNTKIAL | 22 |
| 409 | RPVFSNQFL | 22 |
| 676 | PPSNCSYEL | 22 |
| 792 | APVTPNTEI | 22 |
| 444 | PPLNQSAML | 21 |
| 496 | GPNAKINYL | 21 |
| 404 | IPFRLRPVF | 20 |
| 52 | IPNKSLTTA | 19 |
| 160 | LPAAVDPDV | 19 |
| 258 | IPENAPVGT | 19 |
| 335 | MPARAMVLV | 19 |
| 463 | APVFTQSFV | 19 |
| 758 | QPDSLFSVV | 19 |
| 115 | LPDEIFRLV | 18 |
| 226 | FPQRSSTAI | 18 |
| 352 | VPSIDIRYI | 18 |
| 443 | KPPLNQSAM | 18 |
| 475 | IPENNSPGI | 18 |
| 480 | SPGIQLTKV | 18 |
| 548 | PPLTSNVTV | 18 |
| 686 | LPSTNPGTV | 18 |
| 690 | NPGTVVFQV | 18 |
| 805 | SPTSDYVKI | 18 |
| 877 | SPKNLLLNF | 18 |
| 929 | KPDSPDLAR | 18 |
| 966 | LPLDNTFVA | 18 |
| 165 | DPDVGINGV | 17 |
| 246 | HPVFKETEI | 17 |
| 547 | VPPLTSNVT | 17 |
| 596 | DPDYGDNSA | 17 |

TABLE XXVII-continued

109P1D4
v.1-B0702-9-mers
Each peptide is a portion of SEQ ID NO: 3; each start position is specified, the length of peptide is 9 amino acids, and the end position for each peptide is the start position plus eight.

| | | |
|---|---|---|
| 795 | TPNTEIADV | 17 |
| 856 | TPNPENRQM | 17 |
| 262 | APVGTSVTQ | 16 |
| 438 | AADAGKPPL | 16 |
| 493 | ADSGPNAKI | 16 |
| 506 | GPDAPPEFS | 16 |
| 542 | AKDNGVPPL | 16 |
| 858 | NPENRQMIM | 16 |
| 875 | KHSPKNLLL | 16 |
| 897 | DSDGNRVTL | 16 |
| 907 | LPIDLEEQT | 16 |
| 954 | TPLNSKHHI | 16 |
| 31 | REEMPENVL | 15 |
| 477 | ENNSPGIQL | 15 |
| 507 | PDAPPEFSL | 15 |
| 715 | IVGGNTRDL | 15 |
| 948 | FQIQPETPL | 15 |
| 1010 | RPVGIQVSN | 15 |
| 100 | IPRDEHCFY | 14 |
| 154 | INSKYTLPA | 14 |
| 227 | PQRSSTAIL | 14 |
| 317 | REETPNHKL | 14 |
| 509 | APPEFSLDC | 14 |
| 670 | KPVFIVPPS | 14 |
| 738 | KCDVTDLGL | 14 |
| 762 | LFSVVIVNL | 14 |
| 874 | KKHSPKNLL | 14 |
| 5 | SGTYIFAVL | 13 |
| 49 | LSLIPNKSL | 13 |
| 66 | VYKTGDVPL | 13 |
| 88 | GARIDREKL | 13 |
| 130 | EDINDNAPL | 13 |
| 162 | AAVDPDVGI | 13 |
| 179 | IKSQNIFGL | 13 |

TABLE XXVII-continued

109P1D4
v.1-B0702-9-mers
Each peptide is a portion of SEQ ID NO: 3; each start position is specified, the length of peptide is 9 amino acids, and the end position for each peptide is the start position plus eight.

| | | |
|---|---|---|
| 192 | TPEGDKMPQ | 13 |
| 263 | PVGTSVTQL | 13 |
| 533 | EDKYLFTIL | 13 |
| 599 | YGDNSAVTL | 13 |
| 678 | SNCSYELVL | 13 |
| 742 | TDLGLHRVL | 13 |
| 773 | NESVTNATL | 13 |
| 806 | PTSDYVKIL | 13 |
| 817 | AVAGTITVV | 13 |
| 839 | APHLKAAQK | 13 |
| 899 | DGNRVTLDL | 13 |
| 940 | KSASPQPAF | 13 |
| 951 | QPETPLNSK | 13 |
| 960 | HHIIQELPL | 13 |

TABLE XXVIII

109P1D4
v.1-B08-9-mers
Each peptide is a portion of SEQ ID NO: 3; each start position is specified, the length of peptide is 9 amino acids, and the end position for each peptide is the start position plus eight.

| | | |
|---|---|---|
| 496 | GPNAKINYL | 28 |
| 43 | LLKDLNLSL | 27 |
| 320 | TPNHKLLVL | 26 |
| 453 | FIKVKDEND | 26 |
| 514 | SLDCRTGML | 26 |
| 22 | HPVFKETEI | 24 |
| 246 | STKEYAIKL | 24 |
| 428 | SPKNLLLNF | 24 |
| 877 | FRLVKIRFL | 24 |
| 120 | VMKVKVEDG | 23 |
| 216 | PLNTKIALI | 23 |
| 375 | EDKYLFTIL | 23 |

TABLE XXVIII-continued

109P1D4
v.1-B08-9-mers
Each peptide is a
portion of SEQ ID NO:
3; each start position is
specified, the length of
peptide is 9 amino
acids, and the end
position for each
peptide is the start
position plus eight.

| | | |
|---|---|---|
| 583 | LPRHGTVGL | 23 |
| 41 | GDLLKDLNL | 22 |
| 66 | VYKTGDVPL | 22 |
| 294 | NIARRLFHL | 22 |
| 955 | PLNSKHHII | 22 |
| 88 | GARIDREKL | 21 |
| 736 | MEKCDVTDL | 21 |
| 748 | RVLVKANDL | 21 |
| 866 | MMKKKKKK | 21 |
| 867 | MKKKKKKK | 21 |
| 868 | KKKKKKKH | 21 |
| 869 | KKKKKKHS | 21 |
| 873 | KKKHSPKNL | 21 |
| 875 | KHSPKNLLL | 21 |
| 91 | IDREKLCAG | 20 |
| 193 | PEGDKMPQL | 20 |
| 845 | AQKNKQNSE | 20 |
| 870 | KKKKKKHSP | 20 |
| 871 | KKKKKHSPK | 20 |
| 927 | TFKPDSPDL | 20 |
| 416 | FLLETAAYL | 19 |
| 631 | FDREKQESY | 19 |
| 784 | ELVRKSTEA | 19 |
| 114 | ILPDEIFRL | 18 |
| 122 | LVKIRFLIE | 18 |
| 334 | LMPARAMVL | 18 |
| 374 | IPLNTKIAL | 18 |
| 451 | MLFIKVKDE | 18 |
| 528 | LDREKEDKY | 18 |
| 530 | REKEDKYLF | 18 |
| 656 | SAKVTINVV | 18 |
| 666 | VNDNKPVFI | 18 |
| 734 | TLMEKCDVT | 18 |
| 841 | HLKAAQKNK | 18 |

TABLE XXVIII-continued

109P1D4
v.1-B08-9-mers
Each peptide is a
portion of SEQ ID NO:
3; each start position is
specified, the length of
peptide is 9 amino
acids, and the end
position for each
peptide is the start
position plus eight.

| | | |
|---|---|---|
| 64 | KLVYKTGDV | 17 |
| 72 | VPLIRIEED | 17 |
| 124 | KIRFLIEDI | 17 |
| 218 | KVKVEDGGF | 17 |
| 307 | GLITIKEPL | 17 |
| 362 | NPVNDTVVL | 17 |
| 409 | RPVFSNQFL | 17 |
| 426 | YESTKEYAI | 17 |
| 676 | PPSNCSYEL | 17 |
| 839 | APHLKPAQK | 17 |
| 1006 | AVHTRPVGI | 17 |
| 152 | SAINSKYTL | 16 |
| 176 | YELIKSQNI | 16 |
| 227 | PQRSSTAIL | 16 |
| 310 | TIKEPLDRE | 16 |
| 313 | EPLDREETP | 16 |
| 405 | PFRLRPVFS | 16 |
| 444 | PPLNQSAML | 16 |
| 633 | REKQESYTF | 16 |
| 843 | KAAQKNKQN | 16 |
| 39 | LIGDLLKDL | 15 |
| 117 | DEIFRLVKI | 15 |
| 178 | LIKSQNIFG | 15 |
| 391 | DHNGRVTCF | 15 |
| 433 | AIKLLAADA | 15 |
| 541 | LAKDNGVPP | 15 |
| 805 | SPTSDYVKI | 15 |
| 833 | VVRCRQAPH | 15 |
| 864 | MIMMKKKKK | 15 |
| 51 | LIPNKSLTT | 14 |
| 119 | IFRLVKIRF | 14 |
| 153 | AINSKYTLP | 14 |
| 170 | INGVQNYEL | 14 |
| 177 | ELIKSQNIF | 14 |

TABLE XXVIII-continued

109P1D4
v.1-B08-9-mers
Each peptide is a
portion of SEQ ID NO:
3; each start position is
specified, the length of
peptide is 9 amino
acids, and the end
position for each
peptide is the start
position plus eight.

| | | |
|---|---|---|
| 201 | LIVQKELDR | 14 |
| 203 | VQKELDREE | 14 |
| 226 | FPQRSSTAI | 14 |
| 248 | VFKETEIEV | 14 |
| 281 | NAKIHFSFS | 14 |
| 283 | KIHFSFSNL | 14 |
| 308 | LITIKEPLD | 14 |
| 352 | VPSIDIRYI | 14 |
| 354 | SIDIRYIVN | 14 |
| 403 | EIPFRLRPV | 14 |
| 438 | AADAGKPPL | 14 |
| 498 | NAKINYLLG | 14 |
| 539 | TILAKDNGV | 14 |
| 792 | APVTPNTEI | 14 |
| 808 | SDYVKILVA | 14 |
| 858 | NPENRQMIM | 14 |
| 880 | NLLLNFVTI | 14 |
| 958 | SKHHIIQEL | 14 |

TABLE XXIX

109P1D4
v.1-B1510-9-mers
Each peptide is a
portion of SEQ ID NO
3; each start position is
specified, the length of
peptide is 9 amino
acids, and the end
position for each
peptide is the start
position plus eight.

| | | |
|---|---|---|
| 875 | KHSPKNLLL | 23 |
| 300 | FHLNATTGL | 20 |
| 960 | HHIIQELPL | 20 |
| 391 | DHNGRVTCF | 18 |
| 114 | ILPDEIFRL | 16 |
| 179 | IKSQNIFGL | 16 |
| 715 | IVGGNTRDL | 16 |

TABLE XXIX-continued

109P1D4
v.1-B1510-9-mers
Each peptide is a
portion of SEQ ID NO
3; each start position is
specified, the length of
peptide is 9 amino
acids, and the end
position for each
peptide is the start
position plus eight.

| | | |
|---|---|---|
| 742 | TDLGLHRVL | 16 |
| 897 | DSDGNRVTL | 16 |
| 291 | LVSNIARRL | 15 |
| 400 | TDHEIPFRL | 15 |
| 762 | LFSVVIVNL | 15 |
| 31 | REEMPENVL | 14 |
| 104 | EHCFYEVEV | 14 |
| 120 | FRLVKIRFL | 14 |
| 170 | INGVQNYEL | 14 |
| 318 | EETPNHKLL | 14 |
| 362 | NPVNDTVVL | 14 |
| 374 | IPLNTKIAL | 14 |
| 401 | DHEIPFRLR | 14 |
| 507 | PDAPPEFSL | 14 |
| 599 | YGDNSAVTL | 14 |
| 777 | TNATLINEL | 14 |
| 927 | TFKPDSPDL | 14 |
| 6 | GTYIFAVLL | 13 |
| 66 | VYKTGDVPL | 13 |
| 107 | FYEVEVAIL | 13 |
| 193 | PEGDKMPQL | 13 |
| 245 | NHPVFKETE | 13 |
| 320 | TPNHKLLVL | 13 |
| 429 | TKEYAIKLL | 13 |
| 438 | AADAGKPPL | 13 |
| 542 | AKDNGVPPL | 13 |
| 583 | LPRHGTVGL | 13 |
| 688 | STNPGTVVF | 13 |
| 727 | DQETGNITL | 13 |
| 746 | LHRVLVKAN | 13 |
| 773 | NESVTNATL | 13 |
| 806 | PTSDYVKIL | 13 |
| 5 | SGTYIFAVL | 12 |
| 19 | FHSGAQEKN | 12 |

TABLE XXIX-continued

109P1D4
v.1-B1510-9-mers
Each peptide is a
portion of SEQ ID NO
3; each start position is
specified, the length of
peptide is 9 amino
acids, and the end
position for each
peptide is the start
position plus eight.

| Start | Peptide | Score |
|---|---|---|
| 35 | PENVLIGDL | 12 |
| 88 | GARIDREKL | 12 |
| 152 | SAINSKYTL | 12 |
| 284 | IHFSFSNLV | 12 |
| 307 | GLITIKEPL | 12 |
| 317 | REETPNHKL | 12 |
| 322 | NHKLLVLAS | 12 |
| 334 | LMPARAMVL | 12 |
| 404 | IPFRLRPVF | 12 |
| 477 | ENNSPGIQL | 12 |
| 496 | GPNAKINYL | 12 |
| 497 | PNAKINYLL | 12 |
| 520 | GMLTVVKKL | 12 |
| 529 | DREKEDKYL | 12 |
| 571 | THNEYNFYV | 12 |
| 575 | YNFYVPENL | 12 |
| 602 | NSAVTLSIL | 12 |
| 665 | DVNDNKPVF | 12 |
| 676 | PPSNCSYEL | 12 |
| 678 | SNCSYELVL | 12 |
| 754 | NDLGQPDSL | 12 |
| 874 | KKHSPKNLL | 12 |
| 903 | VTLDLPIDL | 12 |
| 948 | FQIQPETPL | 12 |
| 958 | SKHHIIQEL | 12 |
| 1007 | VHTRPVGIQ | 12 |

TABLE XXX

109P1D4v.1
B2705-9-mers
Each peptide is a
portion of SEQ ID NO: 3;
each start position is
specified, the length of
peptide is 9 amino
acids, and the end
position for each peptide
is the start position plus
eight.

| Start | Peptide | Score |
|---|---|---|
| 120 | FRLVKIRFL | 26 |
| 394 | GRVTCFTDH | 24 |
| 529 | DREKEDKYL | 24 |
| 861 | NRQMIMMKK | 24 |
| 408 | LRPVFSNQF | 23 |
| 625 | IRPNISFDR | 23 |
| 316 | DREETPNHK | 22 |
| 834 | VRCRQAPHL | 22 |
| 41 | GDLLKDLNL | 21 |
| 92 | DREKLCAGI | 20 |
| 197 | KMPQLIVQK | 20 |
| 633 | REKQESYTF | 20 |
| 901 | NRVTLDLPI | 20 |
| 47 | LNLSLIPNK | 19 |
| 304 | ATTGLITIK | 19 |
| 520 | GMLTVVKKL | 19 |
| 584 | PRHGTVGLI | 19 |
| 623 | GVIRPNISF | 19 |
| 748 | RVLVKANDL | 19 |
| 75 | IRIEEDTGE | 18 |
| 177 | ELIKSQNIF | 18 |
| 297 | RRLFHLNAT | 18 |
| 317 | REETPNHKL | 18 |
| 496 | GPNAKINYL | 18 |
| 535 | KYLETILAK | 18 |
| 1013 | GIQVSNTTF | 18 |
| 6 | GTYIFAVLL | 17 |
| 31 | REEMPENVL | 17 |
| 55 | KSLTTAMQF | 17 |
| 114 | ILPDEIFRL | 17 |
| 119 | IFRLVKIRF | 17 |
| 290 | NLVSNIARR | 17 |
| 307 | GLITIKEPL | 17 |
| 309 | ITIKEPLDR | 17 |

TABLE XXX-continued

109P1D4v.1
B2705-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 357 | IRYIVNPVN | 17 |
| 404 | IPFRLRPVF | 17 |
| 409 | RPVFSNQFL | 17 |
| 479 | NSPGIQLTK | 17 |
| 518 | RTGMLTVVK | 17 |
| 530 | REKEDKYLF | 17 |
| 645 | AEDGGRVSR | 17 |
| 649 | GRVSRSSSA | 17 |
| 650 | RVSRSSSAK | 17 |
| 747 | HRVLVKAND | 17 |
| 762 | LFSVVIVNL | 17 |
| 780 | TLINELVRK | 17 |
| 865 | IMMKKKKKK | 17 |
| 948 | FQIQPETPL | 17 |
| 964 | QELPLDNTF | 17 |
| 11 | AVLLACVVF | 16 |
| 37 | NVLIGDLLK | 16 |
| 125 | IRFLIEDIN | 16 |
| 152 | SAINSKYTL | 16 |
| 179 | IKSQNIFGL | 16 |
| 199 | PQLIVQKEL | 16 |
| 209 | REEKDTYVM | 16 |
| 221 | VEDGGFPQR | 16 |
| 276 | ADIGENAKI | 16 |
| 283 | KIHFSFSNL | 16 |
| 337 | ARAMVLVNV | 16 |
| 350 | DNVPSIDIR | 16 |
| 380 | IALITVTDK | 16 |
| 435 | KLLAADAGK | 16 |
| 517 | CRTGMLTVV | 16 |
| 575 | YNFYVPENL | 16 |
| 713 | YSIVGGNTR | 16 |
| 742 | TDLGLHRVL | 16 |
| 777 | TNATLINEL | 16 |

TABLE XXX-continued

109P1D4v.1
B2705-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 827 | VIFITAVVR | 16 |
| 835 | RCRQAPHLK | 16 |
| 839 | APHLKAAQK | 16 |
| 860 | ENRQMIMMK | 16 |
| 862 | TQMIMMKKK | 16 |
| 866 | MMKKKKKKK | 16 |
| 867 | MKKKKKKKK | 16 |
| 868 | KKKKKKKKH | 16 |
| 871 | KKKKKHSPK | 16 |
| 875 | KHSPKNLLL | 16 |
| 940 | KSASPQPAF | 16 |
| 1009 | TRPVGIQVS | 16 |
| 2 | DLLSGTYIF | 15 |
| 23 | AQEKNYTIR | 15 |
| 49 | LSLIPNKSL | 15 |
| 82 | GEIFTTGAR | 15 |
| 88 | GARIDREKL | 15 |
| 112 | VAILPDEIF | 15 |
| 113 | AILPDEIFR | 15 |
| 118 | EIFRLVKIR | 15 |
| 149 | PENSAINSK | 15 |
| 168 | VGINGVQNY | 15 |
| 201 | LIVQKELDR | 15 |
| 208 | DREEKDTYV | 15 |
| 263 | PVGTSVTQL | 15 |
| 289 | SNLVSNIAR | 15 |
| 296 | ARRLFHLNA | 15 |
| 332 | GGLMPARAM | 15 |
| 368 | VVLSENIPL | 15 |
| 372 | ENIPLNTKI | 15 |
| 374 | IPLNTKIAL | 15 |
| 391 | HDNGRVTCF | 15 |
| 399 | FTDHEIPFR | 15 |
| 406 | FRLRPVFSN | 15 |

TABLE XXX-continued

109P1D4v.1
B2705-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 410 | PVFSNQFLL | 15 |
| 416 | FLLETAAYL | 15 |
| 422 | AYLDYESTK | 15 |
| 428 | STKEYAIKL | 15 |
| 438 | AADAGKPPL | 15 |
| 445 | PLNQSAMLF | 15 |
| 449 | SAMLFIKVK | 15 |
| 497 | PNAKINYLL | 15 |
| 519 | TGMLTVVKK | 15 |
| 524 | VVKKLDREK | 15 |
| 542 | AKDNGVPPL | 15 |
| 577 | FYVPENLPR | 15 |
| 662 | NVVDVNDNK | 15 |
| 688 | STNPGTVVF | 15 |
| 727 | DQETGNITL | 15 |
| 728 | QETGNITLM | 15 |
| 744 | LGLHRVLVK | 15 |
| 754 | NDLGQPDSL | 15 |
| 755 | DLGQPDSLF | 15 |
| 779 | ATLINELVR | 15 |
| 820 | GTITVVVVI | 15 |
| 863 | QMIMMKKKK | 15 |
| 873 | KKKHSPKNL | 15 |
| 874 | KKHSPKNLL | 15 |
| 877 | SPKNLLLNF | 15 |
| 894 | DDVDSDGNR | 15 |
| 929 | KPDSPDLAR | 15 |
| 936 | ARHYKSASP | 15 |
| 958 | SKHHIIQEL | 15 |
| 993 | DCGYPVTTF | 15 |
| 18 | VFHSGAQEK | 14 |
| 22 | GAQEKNYTI | 14 |
| 26 | KNYTIREEM | 14 |
| 30 | IREEMPENV | 14 |
| 35 | PENVLIGDL | 14 |
| 43 | LLKDLNLSL | 14 |
| 57 | LTTAMQFKL | 14 |
| 60 | AMQFKLVYK | 14 |
| 66 | VYKTGDVPL | 14 |
| 68 | KTGDVPLIR | 14 |
| 121 | RLVKIRFLI | 14 |
| 130 | EDINDNAPL | 14 |
| 136 | APLFPATVI | 14 |
| 170 | INGVQNYEL | 14 |
| 172 | GVQNYELIK | 14 |
| 212 | KDTYVMKVK | 14 |
| 218 | KVKVEDGGF | 14 |
| 280 | ENAKIHFSF | 14 |
| 291 | LVSNIARRL | 14 |
| 300 | FHLNATTGL | 14 |
| 320 | TPNHKLLVL | 14 |
| 326 | LVLASDGGL | 14 |
| 330 | SDGGLMPAR | 14 |
| 371 | SENIPLNTK | 14 |
| 400 | TDHEIPFRL | 14 |
| 427 | ESTKEYAIK | 14 |
| 443 | KPPLNQSAM | 14 |
| 444 | PPLNQSAML | 14 |
| 483 | IQLTKVSAM | 14 |
| 493 | ADSGPNAKI | 14 |
| 522 | LTVVKKLDR | 14 |
| 527 | KLDREKEDK | 14 |
| 549 | PLTSNVTVF | 14 |
| 599 | YGDNSAVTL | 14 |
| 608 | SILDENDDF | 14 |
| 618 | IDSQTGVIR | 14 |
| 627 | PNISFDREK | 14 |
| 711 | VRYSIVGGN | 14 |

TABLE XXX-continued

109P1D4v.1
B2705-9-mers
Each peptide is a portion of SEQ ID NO: 3; each start position is specified, the length of peptide is 9 amino acids, and the end position for each peptide is the start position plus eight.

| | | |
|---|---|---|
| 738 | KCDVTDLGL | 14 |
| 763 | FSVVIVNLF | 14 |
| 804 | SSPTSDYVK | 14 |
| 836 | CRQAPHLKA | 14 |
| 841 | HLKAAQKNK | 14 |
| 864 | MIMMKKKKK | 14 |
| 897 | DSDGNRVTL | 14 |
| 903 | VTLDLPIDL | 14 |
| 920 | NWVTTPTTF | 14 |
| 951 | QPETPLNSK | 14 |
| 952 | PETPLNSKH | 14 |
| 5 | SGTYIFAVL | 13 |
| 36 | ENVLIGDLL | 13 |
| 59 | TAMQFKLVY | 13 |
| 85 | FTTGARIDR | 13 |
| 87 | TGARIDREK | 13 |
| 89 | ARIDREKLC | 13 |
| 94 | EKLCAGIPR | 13 |
| 99 | GIPRDEHDF | 13 |
| 107 | FYEVEVAIL | 13 |
| 146 | ISIPENSAI | 13 |
| 150 | ENSAINSKY | 13 |
| 190 | IETPEGDKM | 13 |
| 193 | PEGDKMPQL | 13 |
| 275 | DADIGENAK | 13 |
| 278 | IGENAKIHE | 13 |
| 315 | LDREETPNH | 13 |
| 334 | IMPARAMVL | 13 |
| 351 | NVPSIDIRY | 13 |
| 362 | NPVNDTVVL | 13 |
| 415 | QFLLETAAY | 13 |
| 424 | LDYESTKEY | 13 |
| 429 | TKEYAIKLL | 13 |
| 458 | DENDNAPVF | 13 |

TABLE XXX-continued

109P1D4v.1
B2705-9-mers
Each peptide is a portion of SEQ ID NO: 3; each start position is specified, the length of peptide is 9 amino acids, and the end position for each peptide is the start position plus eight.

| | | |
|---|---|---|
| 477 | ENNSPGIQL | 13 |
| 492 | DADSGPNAK | 13 |
| 507 | PDAPPEFSL | 13 |
| 533 | EDKYLFTIL | 13 |
| 569 | VFTHNEYNF | 13 |
| 578 | YVPENLPRH | 13 |
| 583 | LPRHGTVGL | 13 |
| 587 | GTVGLITVT | 13 |
| 631 | FDREKQESY | 13 |
| 632 | DREKQESYT | 13 |
| 652 | SRSSSAKVT | 13 |
| 653 | RSSSAKVTI | 13 |
| 665 | DVNDNKPVF | 13 |
| 674 | IVPPSNCSY | 13 |
| 676 | PPSNCSYEL | 13 |
| 699 | IAVDNDTGM | 13 |
| 715 | IVGGNTRDL | 13 |
| 720 | TRDLFAIDQ | 13 |
| 730 | TGNITLMEK | 13 |
| 736 | MEKCDVTDL | 13 |
| 773 | NESVTNATL | 13 |
| 792 | APVTPNTEI | 13 |
| 821 | TITVVVVIF | 13 |
| 854 | WATPNPENR | 13 |
| 884 | NFVTIEETK | 13 |
| 921 | WVTTPTTFK | 13 |
| 927 | TFKPDSPDL | 13 |
| 930 | PDSPDLARH | 13 |
| 960 | HHIIQELPL | 13 |
| 972 | FVACDSISK | 13 |
| 1002 | EVPVSVHTR | 13 |

TABLE XXXI

109P1D4v.1
B2709-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 120 | FRLVKIRFL | 22 |
| 834 | VRCRQAPHL | 22 |
| 337 | ARAMVLVNV | 21 |
| 30 | IREEMPENV | 20 |
| 529 | DREKEOKYL | 20 |
| 901 | NRVTLDLPI | 20 |
| 408 | LRPVFSNQF | 19 |
| 517 | CRTGMLTVV | 19 |
| 584 | PRHGTVGLI | 19 |
| 786 | VRKSTEAPV | 19 |
| 92 | DREKLCAGI | 18 |
| 208 | DREEKDTYV | 18 |
| 6 | GTYIFAVLL | 17 |
| 41 | GDLLKDLNL | 17 |
| 748 | RVLVKANDL | 17 |
| 297 | RRLFHLNAT | 16 |
| 520 | GMLTVVKKL | 16 |
| 307 | GLITIKEPL | 15 |
| 409 | RPVFSNQFL | 15 |
| 649 | GRVSRSSSA | 15 |
| 711 | VRYSIVGGN | 15 |
| 31 | REEMPENVL | 14 |
| 55 | KSLTTAMQF | 14 |
| 88 | GARIDREKL | 14 |
| 121 | RLVKIRFLI | 14 |
| 125 | IRFLIEDIN | 14 |
| 209 | REEKDTYVM | 14 |
| 229 | RSSTAILQV | 14 |
| 317 | REETPNHKL | 14 |
| 332 | GGLMPARAM | 14 |
| 357 | IRYIVNPVN | 14 |
| 394 | GRVTCFTDH | 14 |
| 530 | REKEDKYLF | 14 |
| 653 | RSSSAKVTI | 14 |
| 820 | GTITVVVI | 14 |
| 875 | KHSPKNLLL | 14 |
| 26 | KNYTIREEM | 13 |
| 76 | RIEEOTGEI | 13 |
| 102 | RDEHCFYEV | 13 |
| 250 | KETEIEVSI | 13 |
| 283 | KIHFSFSNL | 13 |
| 291 | LVSNIARRL | 13 |
| 296 | ARRLFHLNA | 13 |
| 362 | NPVNDTVVL | 13 |
| 368 | VVLSENIPL | 13 |
| 374 | IPLNTKIAL | 13 |
| 406 | FRLRPVFSN | 13 |
| 410 | PVFSNQFLL | 13 |
| 416 | FLLETAAYL | 13 |
| 496 | GPNAKINYL | 13 |
| 542 | AKDNGVPPL | 13 |
| 546 | GVPPLTSNV | 13 |
| 575 | YNFYVPENL | 13 |
| 633 | REKQESYTF | 13 |
| 658 | KVTINVVDV | 13 |
| 718 | GNTRDLFAI | 13 |
| 738 | KCDVTDLGL | 13 |
| 873 | KKKHSPKNL | 13 |
| 874 | KKHSPKNLL | 13 |
| 927 | TFKPDSPDL | 13 |
| 2 | DLLSGTYIF | 12 |
| 5 | SGTYIFAVL | 12 |
| 11 | AVLLACVVF | 12 |
| 22 | GAQEKNYTI | 12 |
| 36 | ENVLIGDLL | 12 |
| 49 | LSLIPNKSL | 12 |
| 67 | YKTGDVPLI | 12 |
| 75 | IRIEEDTGE | 12 |

TABLE XXXI-continued

109P1D4v.1
B2709-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 89 | ARIDREKLC | 12 |
| 99 | GIPRDEHCF | 12 |
| 114 | ILPDEIFRL | 12 |
| 130 | EDINDNAPL | 12 |
| 136 | APLFPATVI | 12 |
| 152 | SAINSKYTL | 12 |
| 170 | INGVQNYEL | 12 |
| 193 | PEGDKMPQL | 12 |
| 195 | GDKMPQLIV | 12 |
| 199 | PQLIVQKEL | 12 |
| 228 | QRSSTAILQ | 12 |
| 263 | PVGTSVTQL | 12 |
| 284 | IHFSFSNLV | 12 |
| 300 | FHLNATTGL | 12 |
| 318 | EETPNHKLL | 12 |
| 326 | LVLASDGGL | 12 |
| 333 | GLMPARAMV | 12 |
| 400 | TDHEIPFRL | 12 |
| 404 | IPFRLRPVF | 12 |
| 438 | AADAGKPPL | 12 |
| 444 | PPLNQSAML | 12 |
| 477 | ENNSPGIQL | 12 |
| 483 | IQLTKVSAM | 12 |
| 497 | PNAKINYLL | 12 |
| 599 | YGDNSAVTL | 12 |
| 623 | GVIRPNISF | 12 |
| 625 | IRPNISFDR | 12 |
| 652 | SRSSSAKVT | 12 |
| 678 | SNCSYELVL | 12 |
| 736 | MEKCDVTDL | 12 |
| 742 | TDLGLHRVL | 12 |
| 747 | KRVLVKAND | 12 |
| 754 | NDLGQPDSL | 12 |
| 760 | DSLFSVVIV | 12 |

TABLE XXXI-continued

109P1D4v.1
B2709-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 762 | LFSVVIVNL | 12 |
| 805 | SPTSDYVKI | 12 |
| 819 | AGTITVVVV | 12 |
| 903 | VTLDLPIDL | 12 |
| 940 | KSASPQPAF | 12 |
| 960 | HHIIQELPL | 12 |
| 43 | LLKDLNLSL | 11 |
| 57 | LTTAMQFKL | 11 |
| 64 | KLVYKTGDV | 11 |
| 66 | VYKTGDVPL | 11 |
| 83 | EIFTTGARI | 11 |
| 106 | CFYEVEVAI | 11 |
| 107 | FYEVEVAIL | 11 |
| 146 | ISIPENSAI | 11 |
| 162 | AAVDPDVGI | 11 |
| 176 | YELIKSQNI | 11 |
| 179 | IKSQNIFGL | 11 |
| 190 | IETPEGDKM | 11 |
| 213 | DTYVMKVKV | 11 |
| 227 | PQRSSTAIL | 11 |
| 320 | TPNHKLLVL | 11 |
| 334 | LMPARAMVL | 11 |
| 340 | MVLVNVTDV | 11 |
| 353 | PSIDIRYIV | 11 |
| 428 | STKEYAIKL | 11 |
| 457 | KDENDNAPV | 11 |
| 507 | PDAPPEFSL | 11 |
| 548 | PPLTSNVTV | 11 |
| 549 | PLTSNVTVF | 11 |
| 569 | VFTHNEYNF | 11 |
| 581 | ENLPRHGTV | 11 |
| 583 | LPRHGTVGL | 11 |
| 597 | PDYGDNSAV | 11 |
| 621 | QTGVIRPNI | 11 |

TABLE XXXI-continued

109P1D4v.1
B2709-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 635 | KQESYTFYV | 11 |
| 676 | PPSNCSYEL | 11 |
| 715 | IVGGNTRDL | 11 |
| 720 | TRDLFAIDQ | 11 |
| 733 | ITLMEKCDV | 11 |
| 757 | GQPDSLFSV | 11 |
| 763 | FSVVIVNLF | 11 |
| 806 | PTSDYVKIL | 11 |
| 821 | TITVVVVIF | 11 |
| 822 | ITVVVVIFI | 11 |
| 836 | CRQAPHLKA | 11 |
| 861 | NRQMIMMKK | 11 |
| 880 | NLLLNFVTI | 11 |
| 895 | DVDSDGNRV | 11 |
| 897 | DSDGNRVTL | 11 |
| 899 | DGNRVTLDL | 11 |
| 936 | ARHYKSASP | 11 |
| 942 | ASPQPAFQI | 11 |
| 948 | FQIQPETPL | 11 |
| 958 | SKHHIIQEL | 11 |
| 964 | QELPLDNTF | 11 |
| 983 | SSSSDPYSV | 11 |
| 995 | GYPVTTFEV | 11 |
| 999 | TTFEVPVSV | 11 |
| 1013 | GIQVSNTTF | 11 |

TABLE XXXII

109P1D4
v.1-B4402-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 318 | EETPNHKLL | 29 |
| 32 | EEMPENVLI | 26 |

TABLE XXXII-continued

109P1D4
v.1-B4402-9-mers
Each peptide is a portion of SEQ ID NO: 3; each start position is specified, the length of peptide is 9 amino acids, and the end position for each peptide is the start position plus eight.

| Start | Peptide | Score |
|---|---|---|
| 964 | QELPLDNTF | 26 |
| 117 | DEIFRLVKI | 25 |
| 458 | DENDNAPVF | 24 |
| 35 | PENVLIGDL | 23 |
| 317 | REETPNHKL | 23 |
| 773 | NESVTNATL | 23 |
| 31 | REEMPENVL | 22 |
| 193 | PEGDKMPQL | 22 |
| 426 | YESTKEYAI | 22 |
| 532 | KEDKYLETI | 22 |
| 77 | IEEDTGEIF | 21 |
| 250 | KETEIEVSI | 21 |
| 418 | LETAAYLDY | 21 |
| 530 | REKEDKYLF | 21 |
| 633 | REKQESYTF | 21 |
| 736 | MEKCDVTDL | 21 |
| 911 | LEEQTMGKY | 21 |
| 176 | YELIKSQNI | 19 |
| 402 | HEIPFRLRP | 18 |
| 11 | AVLLACVVF | 17 |
| 372 | ENIPLNTKI | 17 |
| 645 | AEDGGRVSR | 17 |
| 688 | STNPGTVVF | 17 |
| 875 | KHSPKNLLL | 17 |
| 82 | GEIFTTGAR | 16 |
| 130 | EDINDNAPL | 16 |
| 146 | ISIPENSAI | 16 |
| 152 | SAINSKYTL | 16 |
| 177 | ELIKSQNIF | 16 |
| 276 | ADIGENAKI | 16 |
| 429 | TKEYAIKLL | 16 |
| 520 | GMLTVVKKL | 16 |
| 542 | AKDNGVPPL | 16 |
| 709 | AEVRYSIVG | 16 |

TABLE XXXII-continued

109P1D4
v.1-B4402-9-mers
Each peptide is a
portion of SEQ ID NO:
3; each start position is
specified, the length of
peptide is 9 amino
acids, and the end
position for each
peptide is the start
position plus eight.

| Start | Peptide | Score |
|---|---|---|
| 728 | QETGNITLM | 16 |
| 897 | DSDGNRVTL | 16 |
| 36 | ENVLIGDLL | 15 |
| 55 | KSLTTAMQF | 15 |
| 78 | EEDTGEIFT | 15 |
| 114 | ILPDEIFRL | 15 |
| 120 | FRLVKIRFL | 15 |
| 129 | IEDINDNAP | 15 |
| 150 | ENSAINSKY | 15 |
| 168 | VGINGVQNY | 15 |
| 179 | IKSQNIFGL | 15 |
| 205 | KELDREEKD | 15 |
| 291 | LVSNIARRL | 15 |
| 307 | GLITIKEPL | 15 |
| 362 | NPVNDTVVL | 15 |
| 374 | IPLNTKIAL | 15 |
| 404 | IPFRLRPVF | 15 |
| 415 | QFLLETAAY | 15 |
| 599 | YGDNSAVTL | 15 |
| 623 | GVIRPNISF | 15 |
| 762 | LFSVVIVNL | 15 |
| 777 | TNATLINEL | 15 |
| 806 | PTSDYVKIL | 15 |
| 820 | GTITVVVVI | 15 |
| 880 | NLLLNFVTI | 15 |
| 912 | EEQTMGKYN | 15 |
| 958 | SKHHIIQEL | 15 |

TABLE XXXIIII

109P1D4
v.1-B5101-9-mers
Each peptide is a
portion of SEQ ID NO:
3; each start position is
specified, the length of
peptide is 9 amino
acids, and the end
position for each
peptide is the start
position plus eight.

| Start | Peptide | Score |
|---|---|---|
| 136 | APLFPATVI | 27 |
| 22 | GAQEKNYTI | 26 |
| 303 | NATTGLITI | 26 |
| 548 | PPLTSNVTV | 26 |
| 954 | TPLNSKHHI | 25 |
| 115 | LPDEIFRLV | 24 |
| 165 | DPDVGINGV | 24 |
| 656 | SAKVTINVV | 24 |
| 686 | LPSTNPGTV | 24 |
| 690 | NPGTVVFQV | 24 |
| 818 | VAGTITVVV | 24 |
| 10 | FAVLLACVV | 23 |
| 135 | NAPLFPATV | 23 |
| 160 | LPAAVDPDV | 23 |
| 226 | FPQRSSTAI | 23 |
| 320 | TPNHKLLVL | 23 |
| 352 | VPSIDIRYI | 23 |
| 792 | APVTPNTEI | 23 |
| 805 | SPTSDYVKI | 23 |
| 140 | PATVINISI | 22 |
| 162 | AAVDPDVGI | 22 |
| 246 | HPVFKETEI | 22 |
| 374 | IPLNTKIAL | 22 |
| 475 | IPENNSPGI | 22 |
| 480 | SPGIQLTKV | 22 |
| 691 | PGTVVFQVI | 22 |
| 758 | QPDSLFSVV | 22 |
| 816 | AAVAGTITV | 22 |
| 362 | NPVNDTVVL | 21 |
| 795 | TPNTEIADV | 21 |
| 819 | AGTITVVVV | 21 |
| 69 | TGDVPLIRI | 20 |
| 213 | DTYVMKVKV | 20 |
| 335 | MPARAMVLV | 20 |

TABLE XXXIIII-continued

109P1D4
v.1-B5101-9-mers
Each peptide is a portion of SEQ ID NO: 3; each start position is specified, the length of peptide is 9 amino acids, and the end position for each peptide is the start position plus eight.

| | | |
|---|---|---|
| 496 | GPNAKINYL | 20 |
| 778 | NATLINELV | 20 |
| 987 | DPYSVSDCG | 20 |
| 106 | CFYEVEVAI | 19 |
| 152 | SAINSKYTL | 19 |
| 194 | EGDKMPQLI | 19 |
| 463 | APVFTQSFV | 19 |
| 583 | LPRHGTVGL | 19 |
| 599 | YGDNSAVTL | 19 |
| 708 | NAEVRYSIV | 19 |
| 820 | GTITVVVVI | 19 |
| 899 | DGNRVTLDL | 19 |
| 52 | IPNKSLTTA | 18 |
| 88 | GARIDREKL | 18 |
| 117 | DEIFRLVKI | 18 |
| 138 | LFPATVINI | 18 |
| 336 | PARAMVLVN | 18 |
| 380 | IALITVTDK | 18 |
| 389 | DADHNGRVT | 18 |
| 409 | RPVFSNQFL | 18 |
| 444 | PPLNQSAML | 18 |
| 586 | HGTVGLITV | 18 |
| 601 | DNSAVTLSI | 18 |
| 760 | DSLFSVVIV | 18 |
| 814 | LVAAVAGTI | 18 |
| 966 | LPLDNTFVA | 18 |
| 996 | YPVTTFEVP | 18 |
| 171 | NGVQNYELI | 17 |
| 347 | DVNDNVPSI | 17 |
| 438 | AADAGKPPL | 17 |
| 440 | DAGKPPLNQ | 17 |
| 547 | VPPLTSNVT | 17 |
| 822 | ITVVVVIFI | 17 |
| 880 | NLLLNFVTI | 17 |

TABLE XXXIIII-continued

109P1D4
v.1-B5101-9-mers
Each peptide is a portion of SEQ ID NO: 3; each start position is specified, the length of peptide is 9 amino acids, and the end position for each peptide is the start position plus eight.

| | | |
|---|---|---|
| 5 | SGTYIFAVL | 16 |
| 139 | FPATVINIS | 16 |
| 208 | DREEKDTYV | 16 |
| 232 | TAILQVSVT | 16 |
| 338 | RAMVLVNVT | 16 |
| 404 | IPFRLRPVF | 16 |
| 492 | DADSGPNAK | 16 |
| 508 | DAPPEFSLD | 16 |
| 516 | DCRTGMLTV | 16 |
| 520 | GMLTVVKKL | 16 |
| 676 | PPSNCSYEL | 16 |
| 744 | LGLHRVLVK | 16 |
| 791 | EAPVTPNTE | 16 |
| 973 | VACDSISKC | 16 |
| 999 | TTFEVPVSV | 16 |
| 1 | MDLLSGTYI | 15 |
| 14 | LACVVFHSG | 15 |
| 34 | MPENVLIGD | 15 |
| 59 | TAMQFKLVY | 15 |
| 67 | YKTGDVPLI | 15 |
| 92 | DREKLCAGI | 15 |
| 148 | IPENSAINS | 15 |
| 176 | YELIKSQNI | 15 |
| 185 | FGLDVIETP | 15 |
| 261 | NAPVGTSVT | 15 |
| 262 | APVGTSVTQ | 15 |
| 275 | DADIGENAK | 15 |
| 313 | EPLDREETP | 15 |
| 356 | DIRYIVNPV | 15 |
| 360 | IVNPVNDTV | 15 |
| 449 | SAMLFIKVK | 15 |
| 517 | CRTGMLTVV | 15 |
| 532 | KEDKYLFTI | 15 |
| 552 | SNVTVFVSI | 15 |

TABLE XXXIIII-continued

109P1D4
v.1-B5101-9-mers
Each peptide is a
portion of SEQ ID NO:
3; each start position is
specified, the length of
peptide is 9 amino
acids, and the end
position for each
peptide is the start
position plus eight.

| | | |
|---|---|---|
| 596 | DPDYGDNSA | 15 |
| 644 | KAEDGGRVS | 15 |
| 707 | MNAEVRYSI | 15 |
| 727 | DQETGNITL | 15 |
| 800 | IADVSSPTS | 15 |
| 817 | AVAGTITVV | 15 |
| 1003 | VPVSVHTRP | 15 |
| 30 | IREEMPENV | 14 |
| 72 | VPLIRIEED | 14 |
| 83 | EIFTTGARI | 14 |
| 156 | SKYTLPAAV | 14 |
| 161 | PAAVDPDVG | 14 |
| 211 | EKDTYVMKV | 14 |
| 258 | IPENAPVGT | 14 |
| 276 | ADIGENAKI | 14 |
| 328 | LASDGGLMP | 14 |
| 340 | MVLVNVTDV | 14 |
| 361 | VNPVNDTVV | 14 |
| 366 | DTVVLSENI | 14 |
| 372 | ENIPLNTKI | 14 |
| 421 | AAYLDYEST | 14 |
| 426 | YESTKEYAI | 14 |
| 432 | YAIKLLAAD | 14 |
| 437 | LAADAGKPP | 14 |
| 465 | VFTQSFVTV | 14 |
| 467 | TQSFVTVSI | 14 |
| 493 | ADSGPNAKI | 14 |
| 509 | APPEFSLDC | 14 |
| 539 | TILAKDNGV | 14 |
| 541 | LAKDNGVPP | 14 |
| 579 | VPENLPRHG | 14 |
| 584 | PRHGTVGLI | 14 |
| 597 | PDYGDNSAV | 14 |
| 610 | LDENDDFTI | 14 |

TABLE XXXIIII-continued

109P1D4
v.1-B5101-9-mers
Each peptide is a
portion of SEQ ID NO:
3; each start position is
specified, the length of
peptide is 9 amino
acids, and the end
position for each
peptide is the start
position plus eight.

| | | |
|---|---|---|
| 617 | TIDSQTGVI | 14 |
| 666 | VNDNKPVFI | 14 |
| 699 | IAVDNDTGM | 14 |
| 742 | TDLGLHRVL | 14 |
| 759 | PDSLFSVVI | 14 |
| 768 | VNLFVNESV | 14 |
| 895 | DVDSDGNRV | 14 |
| 897 | DSDGNRVTL | 14 |

TABLE XXXIV

109P1D4
v.1-A1-10-mers
Each peptide is a
portion of SEQ ID NO:
3; each start position is
specified, the length of
peptide is 10 amino
acids, and the end
position for each peptide
is the start position plus
nine.

| | | |
|---|---|---|
| 417 | LLETAAYLDY | 32 |
| 58 | TTAMQFKLVY | 28 |
| 423 | YLDYESTKEY | 28 |
| 527 | KLDREKEDKY | 28 |
| 910 | DLEEQTMGKY | 28 |
| 494 | DSGPNAKINY | 27 |
| 630 | SFDREKQESY | 27 |
| 206 | ELDREEKDTY | 26 |
| 350 | DNVPSIDIRY | 23 |
| 594 | VTDPDYGDNS | 22 |
| 673 | FIVPPSNCSY | 21 |
| 704 | DTGMNAEVRY | 21 |
| 807 | TSDYVKILVA | 21 |
| 985 | SSDPYSVSDC | 21 |
| 163 | AVDPDVGING | 20 |
| 251 | ETEIEVSIPE | 20 |
| 566 | NSPVFTHNEY | 19 |
| 930 | PDSPDLARHY | 19 |

TABLE XXXIV-continued

109P1D4
v.1-A1-10-mers
Each peptide is a portion of SEQ ID NO: 3; each start position is specified, the length of peptide is 10 amino acids, and the end position for each peptide is the start position plus nine.

| | | |
|---|---|---|
| 115 | LPDEIFRLVK | 18 |
| 149 | PENSAINSKY | 18 |
| 239 | VTDTNDNHPV | 18 |
| 273 | ATQADIGENA | 18 |
| 345 | VTDVNDNVPS | 18 |
| 429 | TKEYAIKLLA | 18 |
| 741 | VTDLGLHRVL | 18 |
| 789 | STEAPVTPNT | 18 |
| 897 | DSDGNRVTLD | 18 |
| 19 | FHSGAQEKNY | 17 |
| 107 | FYEVEVAILP | 17 |
| 385 | VTDKDADHNG | 17 |
| 399 | FTDHEIPFRL | 17 |
| 401 | DHEIPFRLRP | 17 |
| 797 | NTEIADVSSP | 17 |
| 904 | TLDLPIDLEE | 17 |
| 40 | IGDLLKDLNL | 16 |
| 44 | LKDLNLSLIP | 16 |
| 167 | DVGINGVQNY | 16 |
| 194 | EGDKMPQLIV | 16 |
| 329 | ASDGGLMPAR | 16 |
| 514 | SLDCRTGMLT | 16 |
| 569 | VFTHNEYNFY | 16 |
| 590 | GLITVTDPDY | 16 |
| 801 | ADVSSPTSDY | 16 |

TABLE XXXV

109P1D4
v.1-A0201-10-mers
Each peptide is a portion of SEQ ID NO: 3; each start position is specified, the length of peptide is 10 amino acids, and the end position for each peptide is the start position plus nine

| | | |
|---|---|---|
| 3 | LLSGTYIFAV | 29 |
| 761 | SLFSVVIVNL | 29 |
| 38 | VLIGDLLKDL | 28 |
| 113 | AILPDEIFRL | 28 |
| 8 | YIFAVLLACV | 27 |
| 169 | GINGVQNYEL | 25 |
| 42 | DLLKDLNLSL | 24 |
| 43 | LLKDLNLSLI | 24 |
| 178 | LIKSQNIFGL | 24 |
| 333 | GLMPARAMVL | 24 |
| 339 | AMVLVNVTDV | 24 |
| 609 | ILDENDDFTI | 24 |
| 50 | SLIPNKSLTT | 23 |
| 56 | SLTTAMQFKL | 23 |
| 114 | ILPDEIFRLV | 23 |
| 325 | LLVLASDGGL | 23 |
| 582 | NLPRHGTVGL | 23 |
| 685 | VLPSTNPGTV | 23 |
| 735 | LMEKCDVTDL | 23 |
| 776 | VTNATLINEL | 23 |
| 137 | PLFPATVINI | 22 |
| 334 | LMPARAMVLV | 22 |
| 359 | YIVNPVNDTV | 22 |
| 474 | SIPENNSPGI | 22 |
| 714 | SIVGGNTRDL | 22 |
| 812 | KILVAAVAGT | 22 |
| 813 | ILVAAVAGTI | 22 |
| 817 | AVAGTITVVV | 22 |
| 882 | LLNFVTIEET | 22 |
| 48 | NLSLIPNKSL | 21 |
| 159 | TLPAAVDPDV | 21 |
| 183 | NIFGLDVIET | 21 |
| 411 | LAKDNGVPPL | 21 |
| 706 | GMNAEVRYSI | 21 |

TABLE XXXV-continued

109P1D4
v.1-A0201-10-mers
Each peptide is a portion of SEQ ID NO: 3; each start position is specified, the length of peptide is 10 amino acids, and the end position for each peptide is the start position plus nine

| Start | Peptide | Score |
|---|---|---|
| 794 | VTPNTEIADV | 21 |
| 818 | VAGTITVVVV | 21 |
| 29 | TIREEMPENV | 20 |
| 51 | LIPNKSLTTA | 20 |
| 60 | AMQFKLVYKT | 20 |
| 233 | AILQVSVTDT | 20 |
| 290 | NLVSNIARRL | 20 |
| 428 | STKEYAIKLL | 20 |
| 437 | LAADAGKPPL | 20 |
| 560 | IIDQNDNSPV | 20 |
| 692 | GTVVFQVIAV | 20 |
| 756 | LGQPDSLFSV | 20 |
| 816 | AAVAGTITVV | 20 |
| 824 | VVVIFITAV | 20 |
| 962 | IIQELPLDNT | 20 |
| 65 | LVYKTGDVPL | 19 |
| 106 | CFYEVEVAIL | 19 |
| 127 | FLIEDINDNA | 19 |
| 257 | SIPENAPVGT | 19 |
| 283 | KIHFSFSNLV | 19 |
| 355 | IDIRYIVNPV | 19 |
| 360 | IVNPVNDTVV | 19 |
| 373 | NIPLNTKIAL | 19 |
| 538 | FTILAKDNGV | 19 |
| 655 | SSAKVTINVV | 19 |
| 767 | IVNLFVNESV | 19 |
| 815 | VAAVAGTITV | 19 |
| 821 | TITVVVVIFI | 19 |
| 887 | TIEETKADDV | 19 |
| 68 | KTGDVPLIRI | 18 |
| 164 | VDPDVGINGV | 18 |
| 262 | APVGTSVTQL | 18 |
| 293 | SNIARRLFHL | 18 |
| 302 | LNATTGLITI | 18 |

TABLE XXXV-continued

109P1D4
v.1-A0201-10-mers
Each peptide is a portion of SEQ ID NO: 3; each start position is specified, the length of peptide is 10 amino acids, and the end position for each peptide is the start position plus nine

| Start | Peptide | Score |
|---|---|---|
| 369 | VLSENIPLNT | 18 |
| 374 | IPLNTKIALI | 18 |
| 402 | HEIPFRLRPV | 18 |
| 479 | NSPGIQLTKV | 18 |
| 482 | GIQLTKVSAM | 18 |
| 549 | PLTSNVTVFV | 18 |
| 650 | RVSRSSSAKV | 18 |
| 657 | AKVTINVVDV | 18 |
| 740 | DVTDLGLHRV | 18 |
| 780 | TLINELVRKS | 18 |
| 781 | LINELVRKST | 18 |
| 785 | LVRKSTEAPV | 18 |
| 12 | VLLACVVFHS | 17 |
| 13 | LLACVVFHSG | 17 |
| 134 | DNAPLFPATV | 17 |
| 145 | NISIPENSAI | 17 |
| 336 | PARAMVLVNV | 17 |
| 376 | LNTKIALITV | 17 |
| 381 | ALITVTDKDA | 17 |
| 445 | PLNQSAMLFI | 17 |
| 466 | FTQSFVTVSI | 17 |
| 495 | SGPNAKINYL | 17 |
| 503 | YLLGPDAPPE | 17 |
| 504 | LLGPDAPPEF | 17 |
| 608 | SILDENDDFT | 17 |
| 732 | NITLMEKCDV | 17 |
| 734 | TLMEKCDVTD | 17 |
| 825 | VVVIFITAVV | 17 |
| 998 | VTTFEVPVSV | 17 |
| 75 | IRIEEDTGEI | 16 |
| 119 | IFRLVKIRFL | 16 |
| 153 | AINSKYTLPA | 16 |
| 231 | STAILDVSVT | 16 |
| 239 | VTDTNDNHPV | 16 |

TABLE XXXV-continued

109P1D4
v.1-A0201-10-mers
Each peptide is a portion
of SEQ ID NO: 3; each
start position is
specified, the length of
peptide is 10 amino
acids, and the end
position for each peptide
is the start position plus
nine

| | | |
|---|---|---|
| 301 | HLNATTGLIT | 16 |
| 319 | ETPNHKLLVL | 16 |
| 351 | NVPSIDIRYI | 16 |
| 354 | SIDIRYIVNP | 16 |
| 416 | FLLETAAYLD | 16 |
| 464 | PVFTQSFVTV | 16 |
| 514 | SLDCRTGMLT | 16 |
| 519 | TGMLTVVKKL | 16 |
| 540 | ILAKDNGVPP | 16 |
| 559 | SIIDQNDNSP | 16 |
| 585 | RHGTVGLITV | 16 |
| 616 | FTIDSQTGVI | 16 |
| 684 | LVLPSTNPGT | 16 |
| 689 | TNPGTVVFQV | 16 |
| 698 | VIAVDNDTGM | 16 |
| 724 | FAIDQETGNI | 16 |
| 726 | IDQETGNITL | 16 |
| 742 | TDLGLHRVLV | 16 |
| 744 | LGLHRVLVKA | 16 |
| 766 | VIVNLFVNES | 16 |
| 809 | DYVKILVAAV | 16 |
| 827 | VIFITAVVRC | 16 |
| 833 | VVRCRQAPHL | 16 |
| 877 | SPKNLLLNFV | 16 |
| 880 | NLLLNFVTIE | 16 |
| 881 | LLLNFVTIEE | 16 |
| 896 | VDSDGNRVTL | 16 |
| 915 | TMGKYNWVTT | 16 |
| 926 | TTFKPDSPDL | 16 |
| 941 | SASPQPAFQI | 16 |
| 2 | DLLSGTYIFA | 15 |
| 6 | GTYIFAVLLA | 15 |
| 21 | SGAQEKNYTI | 15 |
| 46 | DLNLSLIPNK | 15 |

TABLE XXXV-continued

109P1D4
v.1-A0201-10-mers
Each peptide is a portion
of SEQ ID NO: 3; each
start position is
specified, the length of
peptide is 10 amino
acids, and the end
position for each peptide
is the start position plus
nine

| | | |
|---|---|---|
| 91 | IDREKLCAGI | 15 |
| 123 | VKIRFLIEDI | 15 |
| 151 | NSAINSKYTL | 15 |
| 181 | SQNIFGLDVI | 15 |
| 197 | KMPQLIVQKE | 15 |
| 228 | QRSSTAILQV | 15 |
| 230 | SSTAILQVSV | 15 |
| 265 | GTSVTQLHAT | 15 |
| 275 | DADIGENAKI | 15 |
| 328 | LASDGGLMPA | 15 |
| 332 | GGLMPARAMV | 15 |
| 346 | TDVNDNVPSI | 15 |
| 379 | KIALITVTDK | 15 |
| 399 | FTDHEIPFRL | 15 |
| 435 | KLLAADAGKP | 15 |
| 456 | VKDENDNAPV | 15 |
| 490 | AMDADSGPNA | 15 |
| 492 | DADSGPNAKI | 15 |
| 515 | LDCRTGMLTV | 15 |
| 547 | VPPLTSNVTV | 15 |
| 570 | FTHNEYNFYV | 15 |
| 642 | YVKAEDGGRV | 15 |
| 665 | DVNDNKPVFI | 15 |
| 666 | VNDNKPVFIV | 15 |
| 688 | STNPGTVVFQ | 15 |
| 717 | GGNTRDLFAI | 15 |
| 725 | AIDQETGNIT | 15 |
| 741 | VTDLGLHRVL | 15 |
| 745 | GLHRVLVKAN | 15 |
| 769 | NLFVNESVTN | 15 |
| 819 | AGTITVVVI | 15 |
| 879 | KNLLLNFVTI | 15 |
| 957 | NSKHHIIQEL | 15 |

TABLE XXXV-continued

109P1D4
v.1-A0201-10-mers
Each peptide is a portion of SEQ ID NO: 3; each start position is specified, the length of peptide is 10 amino acids, and the end position for each peptide is the start position plus nine

| 982 | SSSSSDPYSV | 15 |
| --- | --- | --- |
| 994 | CGYPVTTFEV | 15 |

TABLE XXXVI

109P1D4
v.1-A0203-10-mers
Each peptide is a portion of SEQ ID NO: 3; each start position is specified, the length of peptide is 10 amino acids, and the end position for each peptide is the start position plus nine

| 154 | INSKYTLPAA | 19 |
| --- | --- | --- |
| 413 | SNQFLLETAA | 19 |
| 430 | KEYAIKLLAA | 19 |
| 808 | SDYVKILVAA | 19 |
| 836 | CRQAPHLKAA | 19 |
| 330 | SDGGLMPARA | 18 |
| 432 | YAIKLLAADA | 18 |
| 810 | YVKILVAAVA | 18 |
| 155 | NSKYTLPAAV | 17 |
| 414 | NQFLLETAAY | 17 |
| 431 | EYAIKLLAAD | 17 |
| 809 | DYVKILVAAV | 17 |
| 837 | RQAPHLKAAQ | 17 |
| 2 | DLLSGTYIFA | 10 |
| 6 | GTYIFAVLLA | 10 |
| 14 | LACVVFHSGA | 10 |
| 51 | LIPNKSLTTA | 10 |
| 80 | DTGEIFTTGA | 10 |
| 89 | ARIDREKLCA | 10 |
| 104 | EHCFYEVEVA | 10 |
| 127 | FLIEDINDNA | 10 |
| 321 | INDNAPLFPA | 10 |
| 441 | INISIPENSA | 10 |

TABLE XXXVI-continued

109P1D4
v.1-A0203-10-mers
Each peptide is a portion of SEQ ID NO: 3; each start position is specified, the length of peptide is 10 amino acids, and the end position for each peptide is the start position plus nine

| 153 | AINSKYTLPA | 10 |
| --- | --- | --- |
| 224 | GGFPQRSSTA | 10 |
| 253 | EIEVSIPENA | 10 |
| 264 | VGTSVTQLHA | 10 |
| 267 | SVTQLHATDA | 10 |
| 273 | ATDADIGENA | 10 |
| 287 | SFSNLVSNIA | 10 |
| 295 | IARRLFHLNA | 10 |
| 320 | TPNHKLLVLA | 10 |
| 328 | LASDGGLMPA | 10 |
| 372 | ENIPLNTKIA | 10 |
| 381 | ALITVTDKDA | 10 |
| 412 | FSNQFLLETA | 10 |
| 424 | LDYESTKEYA | 10 |
| 429 | TKEYAIKLLA | 10 |
| 441 | AGKPPLNQSA | 10 |
| 454 | IKVKDENDNA | 10 |
| 481 | PGIQLTKVSA | 10 |
| 484 | QLTKVSAMDA | 10 |
| 490 | AMDADSGPNA | 10 |
| 500 | KINYLLGPDA | 10 |
| 533 | EDKYLFTILA | 10 |
| 595 | TDPDYGDNSA | 10 |
| 636 | QESYTFYVKA | 10 |
| 648 | GGRVSRSSSA | 10 |
| 691 | PGTVVFQVIA | 10 |
| 700 | AYDNDTGMNA | 10 |
| 716 | VGGNTRDLFA | 10 |
| 744 | LGLHRVLVKA | 10 |
| 770 | LFVNESVTNA | 10 |
| 783 | NELVRKSTEA | 10 |
| 792 | APVTPNTEIA | 10 |
| 807 | TSDYVKILVA | 10 |
| 823 | TVVVVIFITA | 10 |

TABLE XXXVI-continued

109P1D4
v.1-A0203-10-mers
Each peptide is a portion
of SEQ ID NO: 3; each
start position is
specified, the length of
peptide is 10 amino
acids, and the end
position for each peptide
is the start position plus
nine

| Start | Peptide | Score |
|---|---|---|
| 830 | IIAVVRCRQA | 10 |
| 835 | RCRQAPHLKA | 10 |
| 846 | QKNKQNSEWA | 10 |
| 884 | NFVTIEETKA | 10 |
| 927 | TFKPDSPDLA | 10 |
| 933 | PDLARHYKSA | 10 |
| 938 | HYKSASPQPA | 10 |
| 965 | ELPLDNTFVA | 10 |
| 3 | LLSGTYIFAV | 9 |
| 7 | TYIFAVLLAC | 9 |
| 15 | ACVVFHSGAQ | 9 |
| 52 | INPKSLTTAM | 9 |
| 81 | TGEIFTTGAR | 9 |
| 90 | RIDREKLCAG | 9 |
| 105 | HCFYEVEVAI | 9 |
| 128 | LIEDINDNAP | 9 |
| 133 | NDNAPLFPAT | 9 |
| 145 | NISIPENSAI | 9 |
| 225 | GFPQRSSTAI | 9 |
| 254 | IEVSIPENAP | 9 |
| 265 | GTSVTQLHAT | 9 |
| 268 | VTQLHATDAD | 9 |
| 274 | TDADIGENAK | 9 |
| 288 | FSNLVSNIAR | 9 |
| 296 | ARRLFHLNAT | 9 |
| 331 | DGGLMPARAM | 9 |
| 373 | NIPLNTKIAL | 9 |
| 382 | LITVTDKDAD | 9 |
| 425 | DYESTKEYAI | 9 |
| 433 | AIKLLAADAG | 9 |
| 442 | GKPPLNQSAM | 9 |
| 455 | KVKDENDNAP | 9 |
| 482 | GIQLTKVSAM | 9 |
| 485 | LTKVSAMDAD | 9 |

TABLE XXXVI-continued

109P1D4
v.1-A0203-10-mers
Each peptide is a portion
of SEQ ID NO: 3; each
start position is
specified, the length of
peptide is 10 amino
acids, and the end
position for each peptide
is the start position plus
nine

| Start | Peptide | Score |
|---|---|---|
| 491 | MDADSGPNAK | 9 |
| 501 | INYLLGPDAP | 9 |
| 534 | DKYLFTILAK | 9 |
| 596 | DPDYGDNSAV | 9 |
| 637 | ESYTFYVKAE | 9 |
| 649 | GRVSRSSSAK | 9 |
| 692 | GTVVFQVIAV | 9 |
| 701 | VDNDTGMNAE | 9 |
| 717 | GGNTRDLFAI | 9 |
| 745 | GLHRVLVKAN | 9 |
| 771 | FVNESVTNAT | 9 |
| 784 | ELVRKSTEAP | 9 |
| 793 | PVTPNTEIAD | 9 |
| 811 | VKILVAAVAG | 9 |
| 824 | VVVVIFITAV | 9 |
| 831 | TAVVRCRQAP | 9 |
| 847 | KNKQNSEWAT | 9 |
| 885 | FVTIEETKAD | 9 |
| 928 | FKPDSPDLAR | 9 |
| 934 | DLARHYKSAS | 9 |
| 939 | YKSASPQPAF | 9 |
| 966 | LPLDNTFVAC | 9 |

TABLE XXXVII

109P1D4 v.1-A3-10mers
Each peptide is a portion
of SEQ ID NO:3; each
start position is specified
the length of peptide is 10
amino acids, and the end
position for each peptide
is the start position plus
nine

| Start | Peptide | Score |
|---|---|---|
| 743 | DLGLHRVLVK | 28 |
| 826 | VVIFITAVVR | 28 |
| 407 | RLRPVFSNQF | 27 |
| 188 | DVIETPEGDK | 25 |
| 421 | AAYLDYESTK | 25 |

TABLE XXXVII-continued

109P1D4 v.1-A3-10mers
Each peptide is a portion of SEQ ID NO:3; each start position is specified the length of peptide is 10 amino acids, and the end position for each peptide is the start position plus nine

| Start | Peptide | Score |
|---|---|---|
| 11 | AVLLACVVFH | 24 |
| 50 | SLIPNKSLTT | 24 |
| 379 | KIALITVTDK | 24 |
| 817 | AVAGTITVVV | 24 |
| 17 | VVFHSGAQEK | 23 |
| 206 | ELDREEKDTY | 23 |
| 832 | AVVRCRQAPH | 23 |
| 200 | QLIVQKELDR | 22 |
| 298 | RLFHLNATTG | 22 |
| 527 | KLDREKEDKY | 22 |
| 810 | YVKILVAAVA | 22 |
| 813 | ILVAAVAGTI | 22 |
| 46 | DLNLSLIPNK | 21 |
| 220 | KVEDGGFPQR | 21 |
| 333 | GLMPARAMVL | 21 |
| 435 | KLLAADAGKP | 21 |
| 697 | QVIAVDNDTG | 21 |
| 838 | QAPHLKAAQK | 21 |
| 64 | KVKYKTGDVP | 20 |
| 73 | PLIRIEEDTG | 20 |
| 76 | RIEEDTGEIF | 20 |
| 196 | DKMPQLIVQK | 20 |
| 360 | IVNPVNDTVV | 20 |
| 478 | NNSPGIQLTK | 20 |
| 487 | KVSAMDADSG | 20 |
| 517 | CRTGMLTVVK | 20 |
| 523 | TVVKKLDREK | 20 |
| 540 | ILAKDNGVPP | 20 |
| 650 | RVSRSSSAKV | 20 |
| 779 | ATLINELVRK | 20 |
| 16 | CVVFHSGAQE | 19 |
| 115 | LPDEIFRLVK | 19 |
| 163 | AVDPDVGING | 19 |
| 209 | REEKDTYVMK | 19 |
| 417 | LLETAAYLDY | 19 |
| 534 | DKYLFTILAK | 19 |
| 590 | GLITVTDPDY | 19 |
| 617 | TIDSQTGVIR | 19 |
| 623 | GVIRPNISFD | 19 |
| 673 | FIVPPSNCSY | 19 |
| 715 | IVGGNTRDLF | 19 |
| 734 | TLMEKCDVTD | 19 |
| 65 | LVYKTGDVPL | 18 |
| 218 | KVKVEDGGFP | 18 |
| 301 | KLNATTGLIT | 18 |
| 326 | LVLASDGGLM | 18 |
| 327 | VLASDGGLMP | 18 |
| 434 | IKLLAADAGK | 18 |
| 464 | PVFTQSFVTV | 18 |
| 504 | LLGPDAPPEF | 18 |
| 518 | RTGMLTVVKK | 18 |
| 624 | VIRPNISFDR | 18 |
| 658 | KVTINVVDVN | 18 |
| 674 | IVPPSNCSYE | 18 |
| 700 | AVDNDTGMNA | 18 |
| 769 | NLFVNESVTN | 18 |
| 825 | VVVIFITAVV | 18 |
| 864 | MIMMKKKKKK | 18 |
| 910 | DLEEQTMGKY | 18 |
| 934 | DLARHYKSAS | 18 |
| 42 | DLLKDLNLSL | 17 |
| 99 | GIPRDEHCFY | 17 |
| 121 | RLVKERFLIE | 17 |
| 167 | DVGINGVQNY | 17 |
| 270 | QLHATDADIG | 17 |
| 308 | LITIKEPLDR | 17 |
| 314 | PLDREETPNH | 17 |
| 403 | EIPFRLRPVF | 17 |
| 433 | AIKLLAADAG | 17 |
| 448 | QSAMLFIKVK | 17 |

TABLE XXXVII-continued

109P1D4 v.1-A3-10mers
Each peptide is a portion of SEQ ID NO:3; each start position is specified the length of peptide is 10 amino acids, and the end position for each peptide is the start position plus nine

| | | |
|---|---|---|
| 503 | YLLGPDAPPE | 17 |
| 521 | MLTVVKKLDR | 17 |
| 539 | TILAKDNGVP | 17 |
| 546 | GVPPLTSNVT | 17 |
| 582 | NLPRHGTVGL | 17 |
| 609 | ILDENDDFTI | 17 |
| 635 | KQESYTFYVK | 17 |
| 642 | YVKAEDGGRV | 17 |
| 693 | TVVFQVIAVD | 17 |
| 694 | VVFQVIAVDN | 17 |
| 750 | LVKANDLGQP | 17 |
| 765 | VVIVNLFVNE | 17 |
| 803 | VSSPTSDYVK | 17 |
| 814 | LVAAVAGTIT | 17 |
| 870 | KKKKKKHSPK | 17 |
| 949 | QIQPETPLNS | 17 |
| 37 | NVLIGDLLKD | 16 |
| 90 | RIDREKLCAG | 16 |
| 95 | KLCAGIPRDE | 16 |
| 111 | EVAILPDEIF | 16 |
| 113 | AILPDEIFRL | 16 |
| 234 | ILQVSVTDTN | 16 |
| 241 | DTNDNHPVFK | 16 |
| 291 | LVSNIARRLF | 16 |
| 340 | MVLVNVTDVN | 16 |
| 363 | PVNDTVVLSE | 16 |
| 375 | PLNTKIALIT | 16 |
| 381 | ALITVTDKDA | 16 |
| 416 | FLLETAAYLD | 16 |
| 423 | YLDYESTKEY | 16 |
| 436 | LLAADAGKPP | 16 |
| 455 | KVKDENDNAP | 16 |
| 484 | QLTKVSAMDA | 16 |
| 526 | DVNDNKPVFI | 16 |
| 665 | DVNDNKPVFI | 16 |

TABLE XXXVII-continued

109P1D4 v.1-A3-10mers
Each peptide is a portion of SEQ ID NO:3; each start position is specified the length of peptide is 10 amino acids, and the end position for each peptide is the start position plus nine

| | | |
|---|---|---|
| 685 | VLPSTNPGTV | 16 |
| 712 | PYSIVGGNTR | 16 |
| 722 | DLFAIDQETG | 16 |
| 748 | RVLVKANDLG | 16 |
| 764 | SVVIVNLFVN | 16 |
| 785 | LVRKSTEAPV | 16 |
| 812 | KILVAAVAGT | 16 |
| 833 | VVRCRQAPHL | 16 |
| 902 | RVTLDLPIDL | 16 |
| 909 | IDLEEQTMGK | 16 |
| 990 | SVSDCGYPVT | 16 |
| 38 | LVIGDLLKDL | 15 |
| 43 | LLDKLNLSLI | 15 |
| 55 | KSLTTAMQFK | 15 |
| 118 | EIFRLVKIRF | 15 |
| 148 | IPENSAINSK | 15 |
| 156 | SKYTLPAAVD | 15 |
| 257 | SIPENAPVGT | 15 |
| 267 | SVTQLHATDA | 15 |
| 276 | ADIGENAKIH | 15 |
| 315 | LDREETPNHK | 15 |
| 324 | KLLVLASDGG | 15 |
| 341 | VLVNVTDVND | 15 |
| 344 | NVTDVNDNVP | 15 |
| 347 | VDNDNVPSID | 15 |
| 356 | DIRYIVNPVN | 15 |
| 369 | VLSENIPLNT | 15 |
| 370 | LSENIPLNTK | 15 |
| 457 | KDENDNAPVF | 15 |
| 514 | SLDCRTGMLT | 15 |
| 559 | SIIDQNDNSP | 15 |
| 626 | RPNISFDREK | 15 |
| 644 | KAEDGGRVSR | 15 |
| 671 | PVFIVPPSNC | 15 |
| 684 | LVLPSTNPGT | 15 |

TABLE XXXVII-continued

109P1D4 v.1-A3-10mers
Each peptide is a portion
of SEQ ID NO:3; each
start position is specified
the length of peptide is 10
amino acids, and the end
position for each peptide
is the start position plus
nine

| | | |
|---|---|---|
| 761 | SLFSVVIVNL | 15 |
| 767 | IVNLFVNESV | 15 |
| 859 | PENRQMIMMK | 15 |
| 862 | RQMIMMKKKK | 15 |
| 863 | QMIMMKKKKK | 15 |
| 950 | IQPETPLNSK | 15 |
| 961 | HIIQELPLDN | 15 |
| 965 | ELPLDNTFVA | 15 |
| 1004 | PVSVHTRPVG | 15 |
| 1011 | PVGIQVSNTT | 15 |
| 12 | VLLACVVFHS | 14 |
| 36 | ENVLIGDLLK | 14 |
| 51 | LIPNKSLTTA | 14 |
| 58 | TTAMQFKLVY | 14 |
| 59 | TAMQFKLVYK | 14 |
| 124 | KERFLIEDIN | 14 |
| 127 | FLIEDINDNA | 14 |
| 142 | TVINISIPEN | 14 |
| 153 | AINSKYTLPA | 14 |
| 211 | EKDTYVMKVK | 14 |
| 233 | AILQVSVTDT | 14 |
| 255 | EVSIPENAPV | 14 |
| 263 | PVGTSVTQLH | 14 |
| 354 | SIDIRYIVNP | 14 |
| 384 | TVTDKDADHN | 14 |
| 395 | RVTCFTDHEI | 14 |
| 491 | MDADSGPNAK | 14 |
| 500 | KINYLLGPDA | 14 |
| 549 | PLTSNVTVFV | 14 |
| 568 | PVFTHNEYNF | 14 |
| 604 | AVTLSISDEN | 14 |
| 649 | GRVSRSSSAK | 14 |
| 710 | EVRYSIVGGN | 14 |
| 725 | AIDQETGNIT | 14 |
| 745 | GLHRVLVKAN | 14 |

TABLE XXXVII-continued

109P1D4 v.1-A3-10mers
Each peptide is a portion
of SEQ ID NO:3; each
start position is specified
the length of peptide is 10
amino acids, and the end
position for each peptide
is the start position plus
nine

| | | |
|---|---|---|
| 780 | TLINELVRKS | 14 |
| 784 | ELVRKSTEAP | 14 |
| 793 | PVTPNTEIAD | 14 |
| 799 | EIADVSSPTS | 14 |
| 823 | TVVVVIFITA | 14 |
| 834 | VRCRQAPHLK | 14 |
| 860 | ENRQMIMMKK | 14 |
| 879 | KNLLLNFVTI | 14 |
| 880 | NLLLNFVTIE | 14 |
| 883 | LNFVTIEETK | 14 |
| 895 | DVDSDGNRVT | 14 |
| 904 | TLDLPIDLEE | 14 |
| 906 | KLPIDLEEQT | 14 |
| 967 | PLDNTFVACD | 14 |
| 971 | TFVACDSISK | 14 |
| 972 | FVACDSISKC | 14 |
| 977 | SISKCSSSSS | 14 |
| 997 | PVTTFEVPVS | 14 |

TABLE XXXVIII

109P1D4 v.1-A26-10mers
Each peptide is a portion
of SEQ ID NO: 3; each
start position is specified,
the length of peptide is 10
amino acids, and the end
position for each peptide
is the start position plus
nine

| | | |
|---|---|---|
| 167 | DVGINGVQNY | 32 |
| 319 | ETPNHKLLVL | 31 |
| 111 | EVAILPDEIF | 28 |
| 118 | EIFRLVKIRF | 27 |
| 704 | DTGMNAEVRY | 26 |
| 188 | DVIETPEGDK | 25 |
| 710 | EVRYSIVGGN | 25 |
| 109 | EVEVAILPDE | 24 |
| 350 | DNVPSIDIRY | 24 |

TABLE XXXVIII-continued

109P1D4 v.1-A26-10mers
Each peptide is a portion of SEQ ID NO: 3; each start position is specified, the length of peptide is 10 amino acids, and the end position for each peptide is the start position plus nine

| Start | Peptide | Score |
|---|---|---|
| 367 | TVVLSENIPL | 24 |
| 740 | DVTDLGLHRV | 24 |
| 820 | GTITVVVVIF | 24 |
| 277 | DIGENAKIHF | 23 |
| 428 | STKEYAIKLL | 23 |
| 890 | ETKADDVDSD | 23 |
| 71 | DVPLIRIEED | 22 |
| 130 | EDINDNAPLF | 22 |
| 403 | EIPFRLRPVF | 22 |
| 568 | PVFTHNEYNF | 22 |
| 729 | ETGNITLMEK | 22 |
| 910 | DLEEQTMGKY | 22 |
| 206 | ELDREEKDTY | 21 |
| 427 | ESTKEYAIKL | 21 |
| 601 | DNSAVTLSIL | 21 |
| 926 | TTFKPDSPDL | 21 |
| 58 | TTAMQFKLVY | 20 |
| 191 | ETPEGDKMPQ | 20 |
| 213 | DTYVMKVKVE | 20 |
| 255 | EVSIPENAPV | 20 |
| 347 | DVNDNVPSID | 20 |
| 366 | DTVVLSENIP | 20 |
| 494 | DSGPNAKINY | 20 |
| 555 | TVFVSIIDQN | 20 |
| 673 | FIVPPSNCSY | 20 |
| 737 | EKCDVTDLGL | 20 |
| 776 | VTNATLINEL | 20 |
| 902 | RVTLDLPIDL | 20 |
| 999 | TTFEVPVSVH | 20 |
| 1002 | EVPVSVHTRP | 20 |
| 142 | TVINISIPEN | 19 |
| 251 | ETEIEVSIPE | 19 |
| 316 | DREETPNHKL | 19 |
| 623 | GVIRPNISFD | 19 |
| 665 | DVNDNKPVFI | 19 |
| 693 | TVVFQVIAVD | 19 |
| 764 | SVVIVNLFVN | 19 |
| 802 | DVSSPTSDYV | 19 |
| 824 | VVVVIFITAV | 19 |
| 895 | DVDSDGNRVT | 19 |
| 987 | DPYSVSDCGY | 19 |
| 42 | DLLKDLNLSL | 18 |
| 65 | LVYKTGDVPL | 18 |
| 80 | DTGEIFTTGA | 18 |
| 83 | EIFTTGARID | 18 |
| 291 | LVSNIARRLF | 18 |
| 419 | ETAAYLDYES | 18 |
| 461 | DNAPVFTQSF | 18 |
| 574 | EYNFYVPENL | 18 |
| 598 | DYGDNSAVTL | 18 |
| 692 | GTVVFQVIAV | 18 |
| 715 | IVGGNTRDLF | 18 |
| 761 | SLFSVVIVNL | 18 |
| 833 | VVRCRQAPHL | 18 |
| 953 | ETPLNSKHHI | 18 |
| 33 | EMPENVLIGD | 17 |
| 113 | AILPDEIFRL | 17 |
| 178 | LIKSQNIFGL | 17 |
| 241 | DTNDNHPVFK | 17 |
| 262 | APVGTSVTQL | 17 |
| 293 | SNIARRLFHL | 17 |
| 363 | PVNDTVVLSE | 17 |
| 554 | VTVFVSIIDQ | 17 |
| 632 | DREKQESYTF | 17 |
| 714 | SIVGGNTRDL | 17 |
| 775 | SVTNATLINE | 17 |
| 809 | DYVKILVAAV | 17 |
| 823 | TVVVIFITA | 17 |
| 16 | CVVFHSGAQE | 16 |
| 32 | EEMPENVLIG | 16 |

TABLE XXXVIII-continued

109P1D4 v.1-A26-10mers
Each peptide is a portion
of SEQ ID NO: 3; each
start position is specified,
the length of peptide is 10
amino acids, and the end
position for each peptide
is the start position plus
nine

| | | |
|---|---|---|
| 37 | NVLIGDLLKD | 16 |
| 38 | VLIGDLLKDL | 16 |
| 117 | DEIFRLVKIR | 16 |
| 172 | GVQNYELIKS | 16 |
| 210 | EEKDTYVMKV | 16 |
| 309 | ITIKEPLDRE | 16 |
| 399 | FTDHEIPFRL | 16 |
| 410 | PVFSNQFLLE | 16 |
| 522 | LTVVKKLDRE | 16 |
| 529 | DREKEDKYLF | 16 |
| 531 | EKEDKYLFTI | 16 |
| 612 | ENDDFTIDSQ | 16 |
| 662 | NVVDVNDNKP | 16 |
| 741 | VTDLGLHRVL | 16 |
| 750 | LVKANDLGQP | 16 |
| 799 | EIADVSSPTS | 16 |
| 801 | ADVSSPTSDY | 16 |
| 822 | ITVVVIFIT | 16 |
| 972 | FVACDSISKC | 16 |
| 1006 | SVHTRPVGIQ | 16 |

TABLE XXXIX

109P1D4 v.1-B0702-10-mers
Each peptide is a portion
of SEQ ID NO: 3; each
start positon is specified,
the lenght of peptide is 10
amino acids, and the end
position for each peptide
is the start position plus
nine

| | | |
|---|---|---|
| 262 | APVGTSVTQL | 26 |
| 192 | TPEGDKMPQL | 23 |
| 226 | FPQRSSTAIL | 22 |
| 443 | DPPLNQSAML | 22 |
| 506 | GPDAPPEFSL | 22 |
| 52 | IPNKSLTTAM | 21 |
| 409 | RPVFSNQFLL | 21 |
| 496 | GPNAKINYLL | 21 |

TABLE XXXIX-continued

109P1D4 v.1-B0702-10-mers
Each peptide is a portion
of SEQ ID NO: 3; each
start positon is specified,
the lenght of peptide is 10
amino acids, and the end
position for each peptide
is the start position plus
nine

| | | |
|---|---|---|
| 805 | SPTSDYVKIL | 21 |
| 34 | MPENVLIGDL | 20 |
| 198 | MPQLIVQKEL | 20 |
| 675 | VPPSNCSYEL | 20 |
| 686 | LPSTNPGTVV | 20 |
| 758 | QPDSLFSVVI | 20 |
| 1010 | RPVGIQVSNT | 20 |
| 352 | VPSIDIRYIV | 19 |
| 463 | APVFTQSFVT | 19 |
| 548 | PPLTSNVTVF | 19 |
| 583 | LPRHGTVGLI | 19 |
| 690 | NPGTVVFQVI | 19 |
| 792 | APVTPNTEIA | 19 |
| 996 | YPVTTFEVPV | 19 |
| 320 | TPNHDLLVLA | 18 |
| 374 | IPLNTKIALI | 18 |
| 547 | VPPLTSNVTV | 18 |
| 596 | DPDYGDNSAV | 18 |
| 676 | PPSNCSYELV | 18 |
| 856 | TPNPENRQMI | 18 |
| 945 | QPAFQIQPET | 18 |
| 1003 | VPVSVHTRPV | 18 |
| 139 | FPATVINISI | 17 |
| 579 | VPENLPRHGT | 17 |
| 877 | SPKNLLLNFV | 17 |
| 72 | VPLIRIEEDT | 16 |
| 444 | PPLNQSAMLF | 16 |
| 510 | PPEFSLDCRT | 16 |
| 858 | NPENRQMIMM | 16 |
| 907 | LPIDLEEQTM | 16 |
| 954 | TPLNSKHHII | 16 |
| 115 | LPDEIFRLVK | 15 |
| 136 | APLFPATVIN | 15 |
| 335 | MPARAMVLVN | 15 |
| 532 | KEDKYLFTIL | 15 |

TABLE XXXIX-continued

109P1D4 v.1-B0702-10-mers
Each peptide is a portion of SEQ ID NO: 3; each start positon is specified, the lenght of peptide is 10 amino acids, and the end position for each peptide is the start position plus nine

| | | |
|---|---|---|
| 817 | AVAGTITVVV | 15 |
| 896 | VDSDGNRVTL | 15 |
| 4 | LSGTYIFAVL | 14 |
| 40 | IGDLLKDLNL | 14 |
| 65 | LVYKTGDVPL | 14 |
| 119 | IFRLVKIRFL | 14 |
| 129 | IEDINDNAPL | 14 |
| 319 | VNPVNDTVVL | 14 |
| 361 | VNPVNDTVVL | 14 |
| 404 | IPFRLRPVFS | 14 |
| 898 | SDGNRVTLDL | 14 |
| 947 | AFQIQPETPL | 14 |
| 959 | HKKIIQELPL | 14 |
| 966 | LPLDNTFVAC | 14 |
| 42 | DLLKDLNLSL | 14 |
| 100 | IPRDEHCFYE | 13 |
| 113 | AILPDEIFRL | 13 |
| 160 | LPAAVDPDVG | 13 |
| 282 | AKIHFSFSNL | 13 |
| 313 | EPLDREETPN | 13 |
| 333 | GLMPARAMVL | 13 |
| 362 | NPVNDTVVLS | 13 |
| 437 | LAADAGKPPL | 13 |
| 480 | SPGIQLTKVS | 13 |
| 541 | LAKDNGVPPL | 13 |
| 582 | NLPRHGTVGL | 13 |
| 598 | DYGDNSAVTL | 13 |
| 601 | DNSAVTLSIL | 13 |
| 677 | PSNCSYELVL | 13 |
| 714 | SIVGGNTRDL | 13 |
| 735 | LMEKCDVTDL | 13 |
| 737 | EKCDVTDLGL | 13 |
| 753 | ANDLGQPDSL | 13 |
| 833 | VVRCRQAPHL | 13 |

TABLE XXXIX-continued

109P1D4 v.1-B0702-10-mers
Each peptide is a portion of SEQ ID NO: 3; each start positon is specified, the lenght of peptide is 10 amino acids, and the end position for each peptide is the start position plus nine

| | | |
|---|---|---|
| 874 | KKHSPKNLLL | 13 |
| 929 | DPDSPDLARH | 13 |

TABLE XL

109P1D4v.1-B08-10-mers

No Results Found.

TABLE XLI

109P1D4v.1-B1510-10-mers

No Results Found.

TABLE XLII

109P1D4v.1-B2705-10-mers

No Results Found.

TABLE XLIII

109P1D4v.1-B2709-10-mers

No Results Found.

TABLE XLIV

109P1D4 v.1-B4402-10-mers
Each peptide is a portion of SEQ ID NO: 3; each start position is specified, the length of peptide is 10 amino acids, and the end position for each peptide is the start position plus nine

| | | |
|---|---|---|
| 317 | REETPNHKLL | 24 |
| 476 | PENNSPGIQL | 23 |
| 532 | KEDKYLFTIL | 23 |
| 912 | EEQTMGKYNW | 23 |
| 176 | YELIKSQNIF | 22 |
| 773 | NESVTNATLI | 22 |
| 35 | PENVLIGDLL | 21 |
| 82 | GEIFTTGARI | 21 |
| 129 | IEDINDNAPL | 21 |
| 149 | PENSAINSKY | 21 |

TABLE XLIV-continued

109P1D4 v.1-B4402-10-mers
Each peptide is a portion of SEQ ID NO: 3; each start position is specified, the length of peptide is 10 amino acids, and the end position for each peptide is the start position plus nine

| Start | Peptide | Score |
|---|---|---|
| 193 | PEGDKMPQLI | 21 |
| 31 | PEEMPENVLI | 20 |
| 98 | AGIPRDEHCF | 20 |
| 113 | AILPDEIFRL | 20 |
| 279 | GENAKIHFSF | 20 |
| 371 | SENIPLNTKI | 20 |
| 633 | REKQESYTFY | 20 |
| 110 | VEVAILPDEI | 19 |
| 32 | EEMPENVLIG | 18 |
| 78 | EEDTGEIFTT | 18 |
| 130 | EDINDNAPLF | 18 |
| 402 | HEIPFRLRPV | 18 |
| 709 | AEVRYSIVGG | 18 |
| 38 | VLIGDLLKDL | 17 |
| 282 | AKIHFSFSNL | 17 |
| 318 | EETPNHKLLV | 17 |
| 319 | ETPNHKLLVL | 17 |
| 414 | NQFLLETAAY | 17 |
| 428 | STKEYAIKLL | 17 |
| 495 | SGPNAKINYL | 17 |
| 761 | SLFSVVIVNL | 17 |
| 117 | DEIFRLVKIR | 16 |
| 118 | EIFRLVKIRF | 16 |
| 252 | TEIEVSIPEN | 16 |
| 262 | APVGTSVTQL | 16 |
| 333 | GLMPARAMVL | 16 |
| 373 | NIPLNTKIAL | 16 |
| 519 | TGMLTVVKKL | 16 |
| 645 | AEDGGRVSRS | 16 |
| 753 | ANDLGQPDSL | 16 |
| 790 | TEAPVTPNTE | 16 |
| 820 | GTITVVVVIF | 16 |
| 930 | PDSPDLARHY | 16 |
| 1001 | FEVPVSVHTR | 16 |
| 24 | QEKNYTIREE | 15 |

TABLE XLIV-continued

109P1D4 v.1-B4402-10-mers
Each peptide is a portion of SEQ ID NO: 3; each start position is specified, the length of peptide is 10 amino acids, and the end position for each peptide is the start position plus nine

| Start | Peptide | Score |
|---|---|---|
| 48 | NLSLIPNKSL | 15 |
| 54 | NDSLTTAMQF | 15 |
| 119 | IFRLVKIRFL | 15 |
| 123 | VKIRFLIEDI | 15 |
| 137 | PLFPATVINI | 15 |
| 190 | IETPEGDKMP | 15 |
| 205 | KELDREEKDT | 15 |
| 206 | ELDREEKDTY | 15 |
| 210 | EEKDTYVMKV | 15 |
| 291 | LVSNIARRLF | 15 |
| 293 | SNIARRLFHL | 15 |
| 390 | ADHNGRVTCF | 15 |
| 403 | EIPFRLRPVF | 15 |
| 407 | RLRPVFSNQF | 15 |
| 427 | ESTKEYAIKL | 15 |
| 430 | KEYAIKLLAA | 15 |
| 582 | NLPRHGTVGL | 15 |
| 896 | VDSDGNRVTL | 15 |
| 941 | SASPQPAFQI | 15 |
| 952 | PETPLNSKHH | 15 |
| 5 | SGTYIFAVLL | 14 |
| 19 | FHSGAQEKNY | 14 |
| 34 | MPENVLIGDL | 14 |
| 108 | YEVEVAILPD | 14 |
| 312 | KEPLDREETP | 14 |
| 350 | DNVPSIDIRY | 14 |
| 351 | NVPSIDIRYI | 14 |
| 361 | VNPVNDTVVL | 14 |
| 374 | IPLNTKIALI | 14 |
| 397 | TCFTDHEIPF | 14 |
| 423 | YLDYESTKEY | 14 |
| 444 | PPLNQSAMLF | 14 |
| 457 | KDENDNAPVF | 14 |
| 461 | DNAPVFTQSF | 14 |
| 494 | DSGPNAKINY | 14 |

TABLE XLIV-continued

109P1D4 v.1-B4402-10-mers
Each peptide is a portion of SEQ ID NO: 3; each start position is specified, the length of peptide is 10 amino acids, and the end position for each peptide is the start position plus nine

| Start | Peptide | Score |
|---|---|---|
| 504 | LLGPDAPPEF | 14 |
| 511 | PEFSLDCRTG | 14 |
| 527 | KLDREKEDKY | 14 |
| 548 | PPLTSNVTVF | 14 |
| 590 | GLITVTDPDY | 14 |
| 598 | DYGDNSAVTL | 14 |
| 607 | LSISDENDDF | 14 |
| 616 | FTIDSQTGVI | 14 |
| 687 | PSTNPGTVVF | 14 |
| 714 | SIVGGNTRDL | 14 |
| 737 | EKCDVTDLGL | 14 |
| 741 | VTDLGLHRVL | 14 |
| 754 | NDLGQPDSLF | 14 |
| 762 | LFSVVIVNLF | 14 |
| 776 | VTNATLINEL | 14 |
| 801 | ADVSSPTSDY | 14 |
| 805 | SPTSDYVKIL | 14 |
| 819 | AGTITVVVVI | 14 |
| 845 | AQKNKQNSEW | 14 |
| 859 | PENRQMIMMK | 14 |
| 872 | KKKKHSPKNL | 14 |
| 879 | KNLLLNFVTI | 14 |
| 898 | SDGNRVTLDL | 14 |
| 957 | NSKHHIIQEL | 14 |
| 964 | QELPLDNTFV | 14 |
| 992 | SDCGYPVTTF | 14 |
| 1012 | VGIQVSNTTF | 14 |
| 1 | MDLLSGTYIF | 13 |
| 4 | LSGTYIFAVL | 13 |
| 10 | FAVLLACVVF | 13 |
| 40 | IGDLLKDLNL | 13 |
| 56 | SLTTAMQFKL | 13 |
| 87 | TGARIDREKL | 13 |
| 105 | HCFYEVEVAI | 13 |
| 135 | NAPLFPATVI | 13 |
| 178 | LIKSQNIFGL | 13 |
| 198 | MPQLIVQKEL | 13 |
| 221 | VEDGGFPQRS | 13 |
| 254 | IEVSIPENAP | 13 |
| 290 | NLVSNIARRL | 13 |
| 415 | QFLLETAAYL | 13 |
| 443 | KPPLNQSAML | 13 |
| 458 | DENDNAPVFT | 13 |
| 513 | FSLDCRTGML | 13 |
| 531 | EKEQKYLETI | 13 |
| 566 | NSPVFTHNEY | 13 |
| 568 | PVFTHNEYNF | 13 |
| 573 | NEYNFYVPEN | 13 |
| 574 | EYNFYVPENL | 13 |
| 611 | DENDDFTIDS | 13 |
| 630 | SFDREKQESY | 13 |
| 636 | QESYTFYVKA | 13 |
| 673 | FIVPPSNCSY | 13 |
| 715 | IVGGNTRDLF | 13 |
| 724 | FAIDQETGNI | 13 |
| 728 | QETGNITLME | 13 |
| 747 | HRVLVKANDL | 13 |
| 798 | TEIADVSSPT | 13 |
| 804 | SSPTSDYVKI | 13 |
| 873 | KKKHSPKNLL | 13 |
| 874 | KKHSPKNLLL | 13 |
| 876 | HSPKNLLLNF | 13 |
| 889 | EETKADDVDS | 13 |
| 902 | RVTLOLPIDL | 13 |
| 939 | YKSASPQPAF | 13 |
| 947 | AFQIQPETPL | 13 |
| 953 | ETPLNSKHHI | 13 |
| 963 | IQELPLDNTF | 13 |
| 30 | IREEMPENVL | 12 |
| 42 | DLLKDLNLSL | 12 |

TABLE XLIV-continued

109P1D4 v.1-B4402-10-mers
Each peptide is a portion of SEQ ID NO: 3; each start position is specified, the length of peptide is 10 amino acids, and the end position for each peptide is the start position plus nine

| Start | Peptide | Score |
|---|---|---|
| 58 | TTAMQFKLVY | 12 |
| 68 | KTGDVPLIRI | 12 |
| 75 | IRIEEDTGEI | 12 |
| 77 | IEEDTGEIFT | 12 |
| 93 | REKLCAGIPR | 12 |
| 99 | GIPRDEHCFY | 12 |
| 111 | EVAILPDEIF | 12 |
| 145 | NISIPENSAI | 12 |
| 151 | NSAINSKYTL | 12 |
| 192 | TPEGDKMPQL | 12 |
| 226 | FPQRSSTAIL | 12 |
| 240 | TDTNDNHPVF | 12 |
| 250 | KETEIEVSIP | 12 |
| 299 | LFHLNATTGL | 12 |
| 300 | FHLNATTGLI | 12 |
| 302 | LNATTGLITI | 12 |
| 316 | DREETPNHKL | 12 |
| 367 | TVVLSENIPL | 12 |
| 399 | FTDHEIPFRL | 12 |
| 417 | LLETAAYLDY | 12 |
| 426 | YESTKEYAIK | 12 |
| 528 | LQREKEDKYL | 12 |
| 541 | LAKDNGVPPL | 12 |
| 561 | IDQNDNSPVF | 12 |
| 580 | PENLPRHGTV | 12 |
| 601 | DNSAVTLSIL | 12 |
| 652 | SRSSSAKVTI | 12 |
| 664 | VDVNDNKPVF | 12 |
| 677 | PSNCSYELVL | 12 |
| 690 | NPGTVVFQVI | 12 |
| 717 | GGNTRDLFAI | 12 |
| 726 | IDQETGNITL | 12 |
| 736 | MEKCDVTDLG | 12 |
| 783 | NELVRKSTEA | 12 |
| 856 | TPNPENRQMI | 12 |

TABLE XLIV-continued

109P1D4 v.1-B4402-10-mers
Each peptide is a portion of SEQ ID NO: 3; each start position is specified, the length of peptide is 10 amino acids, and the end position for each peptide is the start position plus nine

| Start | Peptide | Score |
|---|---|---|
| 888 | IEETKADDVD | 12 |
| 911 | LEEQTMGKYN | 12 |
| 919 | YNWVTTPTTF | 12 |
| 926 | TTFKPDSPDL | 12 |
| 959 | KHHIQELPL | 12 |
| 980 | KCSSSSSDPY | 12 |

TABLE XLV

109P1D4v.1-B5101-10-mers

No Results Found.

TABLE XLVI

109P1D4v.1-DRB1 0101-15-mers
Each peptide is a portion of SEQ ID NO: 3; each start position is specified, the length of peptide is 15 amino acids, and the end position for each peptide is the start position plus fourteen

| Start | Peptide | Score |
|---|---|---|
| 808 | SDYVKILVAAVAGTI | 36 |
| 7 | TYIFAVLLACVVFHS | 34 |
| 265 | GTSVTQLHATDADIG | 34 |
| 482 | GIQLTKVSAMDADSG | 33 |
| 498 | NAKINYLLGPDAPPE | 33 |
| 285 | HFSFSNLVSNIARRL | 32 |
| 173 | VQNYELIKSQNIFGL | 31 |
| 405 | PFRLRPVFSNQFLLE | 30 |
| 117 | DEIFRLVKIRFLIED | 28 |
| 155 | NSKYTLPAAVDPDVG | 28 |
| 297 | RRLFHLNATTGLITI | 28 |
| 710 | EVRYSIVGGNTRDLF | 28 |
| 797 | NTEIADVSSPTSDYV | 28 |
| 882 | LLNFVTIEETKADDV | 28 |
| 945 | QPAFQIQPETPLNSK | 28 |
| 109 | EVEVAILPDEIFRLV | 27 |
| 413 | SNQFLLETAAYLDYE | 27 |
| 807 | TSDYVKILVAAVAGT | 27 |

TABLE XLVI-continued

109P1D4v.1-DRB1 0101-15-mers
Each peptide is a portion of SEQ ID NO: 3; each start position is specified, the length of peptide is 15 amino acids, and the end position for each peptide is the start position plus fourteen

| | | |
|---|---|---|
| 90 | RIDREKLCAGIPRDE | 26 |
| 105 | HCFYEVEVAILPDEI | 26 |
| 141 | ATVINISIPENSAIN | 26 |
| 187 | LDVIETPEGDKMPQL | 26 |
| 288 | FSNLVSNIARRLFHL | 26 |
| 430 | KEYAIKLLAADAGKP | 26 |
| 431 | EYAIKLLAADAGKPP | 26 |
| 538 | FTILAKDNGVPPLTS | 26 |
| 572 | HNEYNFYVPENLPRH | 26 |
| 596 | DPDYGDNSAVTLSIL | 26 |
| 738 | KCDVTDLGLHRVLVK | 26 |
| 823 | TVVVVIFITAVVRCR | 26 |
| 831 | TAVVRCRQAPHLKAA | 26 |
| 33 | EMPENVLIGDLLKDL | 25 |
| 41 | GDLLKDLNLSLIPNK | 25 |
| 62 | QFKLVYKTGDVPLIR | 25 |
| 104 | EHCFYEVEVAILPDE | 25 |
| 176 | YELIKSQNIFGLDVI | 25 |
| 216 | VMKVKVEDGGFPQRS | 25 |
| 223 | DGGFPQRSSTAILQV | 25 |
| 296 | ARRLFHLNATTGLIT | 25 |
| 325 | LLVLASDGGLMPARA | 25 |
| 337 | ARAMVLVNVTDVNDN | 25 |
| 433 | AIKLLAADAGKPPLN | 25 |
| 434 | IKLLAADAGKPPLNQ | 25 |
| 580 | PENLPRHGTVGLITV | 25 |
| 613 | NDDFTIDSQTGVIRP | 25 |
| 640 | TFYVKAEDGGRVSRS | 25 |
| 730 | TGNITLMEKCDVTDL | 25 |
| 764 | HSWIVNLFVNESVTN | 25 |
| 811 | VKILVAAVAGTITVV | 25 |
| 925 | PTTFKPDSPDLARHY | 25 |
| 936 | ARHYKSASPQPAFQI | 24 |
| 27 | NYTIREEMPENVLIG | 24 |
| 46 | DLNLSLIPNKSLTTA | 24 |
| 74 | LIRIEEDTGEIFTTG | 24 |

TABLE XLVI-continued

109P1D4v.1-DRB1 0101-15-mers
Each peptide is a portion of SEQ ID NO: 3; each start position is specified, the length of peptide is 15 amino acids, and the end position for each peptide is the start position plus fourteen

| | | |
|---|---|---|
| 116 | PDEIFRLVKIRFLIE | 24 |
| 145 | NISIPENSAINSKYT | 24 |
| 322 | NHKLLVLASDGGLMP | 24 |
| 324 | KLLVLASDGGLMPAR | 24 |
| 329 | ASDGGLMPARAMVLV | 24 |
| 331 | DGGLMPARAMVLVNV | 24 |
| 358 | RYIVNPVNDTVVLSE | 24 |
| 472 | TVSIPENNSPGIQLT | 24 |
| 478 | NNSPGIQLTKVSAMD | 24 |
| 488 | VSAMDADSGPNAKIN | 24 |
| 499 | AKINYLLGPDAPPEF | 24 |
| 586 | HGTVGLITVTDPDYG | 24 |
| 660 | TINVVDVNDNKPVFI | 24 |
| 670 | KPVFIVPPSNCSYEL | 24 |
| 698 | VIAVDNDTGMNAEVR | 24 |
| 712 | RYSIVGGNTRDLFAI | 24 |
| 745 | GLHRVLVKANDLGQP | 24 |
| 760 | DSLFSVVIVNLFVNE | 24 |
| 822 | ITVVVVIFITAVVRC | 24 |
| 885 | FVTIEETKADDVDSD | 24 |
| 900 | GNRVTLDLPIDLEEQ | 24 |
| 919 | YNWVTTPTTFKPDSP | 24 |
| 975 | CDSISKCSSSSSDPY | 24 |
| 3 | LLSGTYIFAVLLACV | 23 |
| 45 | KDLNLSLIPNKSLTT | 23 |
| 78 | EEDTGEIFTTGARID | 23 |
| 129 | IEDINDNAPLFPATV | 23 |
| 151 | NSAINSKYTLPAAVD | 23 |
| 167 | DVGINGVQNYELIKS | 23 |
| 281 | NAKIHFSFSNLVSNI | 23 |
| 289 | SNLVSNIARRLFHLN | 23 |
| 342 | LVNVTDVNDNVPSID | 23 |
| 349 | NDNVPSIDIRYIVNP | 23 |
| 370 | LSENIPLNTKIALIT | 23 |
| 379 | KIALITVTDKDADHN | 23 |
| 531 | EKEDKYLFTILAKDN | 23 |

TABLE XLVI-continued

109P1D4v.1-DRB1 0101-15-mers
Each peptide is a portion of SEQ ID NO: 3; each start position is specified, the length of peptide is 15 amino acids, and the end position for each peptide is the start position plus fourteen

| | | |
|---|---|---|
| 534 | DKYLFTILAKDNGVP | 23 |
| 547 | VPPLTSNVTVFVSII | 23 |
| 630 | SFDREKQESYTFYVK | 23 |
| 648 | GGRVSRSSSAKVTIN | 23 |
| 663 | VVDVNDNKPVFIVPP | 23 |
| 669 | NKPVFIVPPSNCSYE | 23 |
| 679 | NQSYELVLPSTNPGT | 23 |
| 680 | CSYELVLPSTNPGTV | 23 |
| 782 | INELVRKSTEAPVTP | 23 |
| 812 | KILVAAVAGTITVVV | 23 |
| 819 | AGTITVVVIFITAV | 23 |
| 821 | TITVVVVIFITAVVR | 23 |
| 824 | VVVVIFITAVVRCRQ | 23 |
| 844 | AAQKNKQNSEWATPN | 23 |
| 916 | MGKYNWVTTPTTFKP | 23 |
| 963 | IQELPLDNTFVACDS | 23 |
| 6 | GTYIFAVLLACVVFH | 23 |
| 126 | RFLIEDINDNAPLFP | 23 |
| 132 | INDNAPLFPATVINI | 23 |
| 178 | LIKSQNIFGLDVIET | 23 |
| 251 | ETEIEVSIPENAPVG | 23 |
| 328 | LASDGGLMPARAMVL | 23 |
| 402 | HEIPFRLRPVFSNQF | 23 |
| 442 | GKPPLNQSAMLFIKV | 23 |
| 462 | NAPVFTQSFVTVSIP | 22 |
| 485 | LTKVSAMDADSGPNA | 22 |
| 502 | NYLLGPDAPPEFSLD | 22 |
| 510 | PPEFSLDCRTGMLTV | 22 |
| 535 | KYLFTILAKDNGVPP | 22 |
| 544 | DNGVPPLTSNVTVFV | 22 |
| 557 | FVSIIDQNDNSPVFT | 22 |
| 615 | DFTIDSQTGVIRPNI | 22 |
| 683 | ELVLPSTNPGTVVFQ | 22 |
| 692 | GTVVFQVIAVDNDTG | 22 |
| 753 | ANDLGQPDSLFSVVI | 22 |
| 756 | LGQPDSLFSVVIVNL | 22 |

TABLE XLVI-continued

109P1D4v.1-DRB1 0101-15-mers
Each peptide is a portion of SEQ ID NO: 3; each start position is specified, the length of peptide is 15 amino acids, and the end position for each peptide is the start position plus fourteen

| | | |
|---|---|---|
| 759 | PDSLFSVVIVNLFVN | 22 |
| 800 | IADVSSPTSDYVKIL | 22 |
| 815 | VAAVAGTITVVVVIF | 22 |
| 939 | YKSASPQPAFQIQPE | 22 |
| 947 | AFQIQPETPLNSKHH | 22 |
| 1001 | FEVPVSVHTRPVGIQ | 22 |
| 60 | AMQFKLVYKTGDVPL | 21 |
| 108 | YEVEVAILPDEIFRL | 21 |
| 184 | IFGLDVIETPEGDKM | 21 |
| 363 | PVNDTVVLSENIPLN | 21 |
| 541 | LAKDNGVPPLTSNVT | 21 |
| 722 | DLFAIDQETGNITLM | 21 |
| 143 | VINISIPENSAINSK | 21 |
| 215 | YVMKVKVEDGGFPQR | 21 |
| 222 | EDGGFPQRSSTAILQ | 21 |
| 246 | HPVFKETEIEVSIPE | 21 |
| 253 | EIEVSIPENAPVGTS | 21 |
| 323 | HKLLVLASDGGLMPA | 20 |
| 346 | TDVNDNVPSIDIRYI | 20 |
| 425 | DYESTKEYAIKLLAA | 20 |
| 459 | ENDNAPVFTQSFVTV | 20 |
| 463 | APVFTQSFVTVSIPE | 20 |
| 470 | FVTVSIPENNSPGIQ | 20 |
| 522 | LTVVKKLDREKEDKY | 20 |
| 619 | DSQTGVIRPNISFDR | 20 |
| 768 | VNLFVNESVTNATLI | 20 |
| 783 | NELVRKSTEAPVTPN | 20 |
| 883 | LNFVTIEETKADDVD | 20 |
| 944 | PQPAFQIQPETPLNS | 20 |
| 992 | SDCGYPVTTFEVPVS | 20 |
| 63 | FKLVYKTGDVPLIRI | 19 |
| 64 | KLVYKTGDVPLIRIE | 19 |
| 122 | LVKIRFLIEDINDNA | 19 |
| 182 | QNIFGLDVIETPEGD | 19 |
| 306 | TGLITIKEPLDREET | 19 |
| 352 | VPSIDIRYIVNPVND | 19 |

TABLE XLVI-continued

109P1D4v.1-DRB1 0101-15-mers
Each peptide is a portion of SEQ ID NO: 3; each start position is specified, the length of peptide is 15 amino acids, and the end position for each peptide is the start position plus fourteen

| | | |
|---|---|---|
| 365 | NDTVVLSENIPLNTK | 19 |
| 420 | TAAYLDYESTKEYAI | 19 |
| 500 | KINYLLGPDAPPEFS | 19 |
| 604 | AVTLSILDENDDFTI | 19 |
| 696 | FQVIAVDNDTGMNAE | 19 |
| 733 | ITLMEKCDVTDLGLH | 19 |
| 8 | YIFAVLLACVVFHSG | 18 |
| 14 | LACVVFHSGAQEKNY | 18 |
| 40 | IGDLLKDLNLSLIPN | 18 |
| 50 | SLIPNKSLTTAMQFK | 18 |
| 54 | NKSLTTAMQFKLVYK | 18 |
| 81 | TGEIFTTGARIDREK | 18 |
| 133 | NDNAPLFPATVINIS | 18 |
| 136 | APLFPATVINISIPE | 18 |
| 170 | INGVQNYELIKSQNI | 18 |
| 245 | NHPVFKETEIEVSIP | 18 |
| 257 | SIPENAPVGTSVTQL | 18 |
| 293 | SNIARRLFHLNATTG | 18 |
| 319 | ETPNHKLLVLASDGG | 18 |
| 411 | VFSNQFLLETAAYLD | 18 |
| 423 | YLDYESTKEYAIKLL | 18 |
| 450 | AMLFIKVKDENDNAP | 18 |
| 641 | FYVKAEDGGRVSRSS | 18 |
| 717 | GGNTRDLFAIDQETG | 18 |
| 750 | LVKANDLGQPDSLFS | 18 |
| 762 | LFSVVIVNLFNVESV | 18 |
| 765 | VVIVNLFVNESVTNA | 18 |
| 778 | NATLINELVRKSTEA | 18 |
| 779 | ATLINELVRKSTEAP | 18 |
| 870 | KKKKKKHSPKNLLLN | 18 |
| 918 | KYNWVTTPTTFKPDS | 18 |
| 986 | SDPYSVSDCGYPVTT | 18 |
| 993 | DCGYPVTTFEVPVSV | 18 |
| 995 | GYPVTTFEVPVSVHT | 18 |

TABLE XLVII

109P1D4v.1-DRBI 0301-15-mers
Each peptide is a portion of SEQ ID NO: 3; each start position is specified, the length of peptide is 15 amino acids, and the end posiflon for each peptide is the start position plus fourteen

| | | |
|---|---|---|
| 40 | IGDLLKDLNLSLIPN | 38 |
| 111 | EVAILPDEIFRLVKI | 32 |
| 900 | GNRVTLDLPIDLEEQ | 31 |
| 36 | ENVLIGDLLKDLNLS | 30 |
| 74 | LIRIEEDTGEIFTTG | 29 |
| 97 | CAGIPRDEHCFYEVE | 29 |
| 125 | IRFLIEOINDNAPLF | 29 |
| 502 | NYLLGPDAPPEFSLD | 29 |
| 893 | ADDVDSDGNRVTLDL | 28 |
| 365 | NDTVVLSENIPLNTK | 27 |
| 605 | VTLSILDENDDFTID | 27 |
| 671 | PVFIVPPSNCSYELV | 27 |
| 904 | TLDLPIDLEEQTMGK | 27 |
| 46 | DLNLSLIPNKSLTTA | 26 |
| 54 | NKSLTTAMQFKLVYK | 26 |
| 371 | SENIPLNTKIALITV | 26 |
| 525 | VKKLDREKEDKYLFT | 26 |
| 613 | NDDFTIDSQTGVIRP | 26 |
| 626 | RPNISFDREKQESYT | 26 |
| 204 | QKELDREEKDTYVMK | 25 |
| 275 | DADIGENAKIHFSFS | 25 |
| 289 | SNLVSNIARRLFHLN | 25 |
| 401 | DHEIPFRLRPVFSNQ | 25 |
| 510 | PPEFSLDCRTGMLTV | 25 |
| 566 | NSPVFTHNEYNFYVP | 25 |
| 662 | NVVDVNDNKPVFIVP | 25 |
| 713 | YSIVGGNTRDLFAID | 25 |
| 116 | PDEIFRLVKIRFLIE | 24 |
| 167 | DVGINGVQNYELIKS | 24 |
| 395 | RVTCFTDHEIPFRLR | 24 |
| 721 | RDLFAIDQETGNITL | 24 |
| 325 | LLVLASDGGLMPARA | 23 |
| 628 | NISFDREKQESYTFY | 23 |
| 945 | QPAFQIQPETPLNSK | 23 |
| 161 | PAAVDPDVGINGVQN | 22 |
| 488 | VSAMDADSGPNAKIN | 22 |

TABLE XLVII-continued

109P1D4v.1-DRBI 0301-15-mers
Each peptide is a portion of SEQ ID NO: 3; each start position is specified, the length of peptide is 15 amino acids, and the end posiflon for each peptide is the start position plus fourteen

| | | |
|---|---|---|
| 925 | PTTFKPDSPDLARHY | 22 |
| 970 | NTFVACDSISKCSSS | 22 |
| 165 | DPDVGINGVQNYELI | 21 |
| 323 | HKLLVLASDGGLMPA | 21 |
| 405 | PFRLRPVFSNQFLLE | 21 |
| 538 | FTILAKDNGVPPLTS | 21 |
| 698 | VIAVDNDTGMNAEVR | 21 |
| 759 | PDSLFSVVIVNLFVN | 21 |
| 963 | IQELPLDNTFVACDS | 21 |
| 63 | FKLVYKTGDVPLIRI | 20 |
| 128 | LIEDINDNAPLFPAT | 20 |
| 176 | YELIKSQNIFGLDVI | 20 |
| 288 | FSNLVSNIARRLFHL | 20 |
| 413 | SNQFLLETAAYLDYE | 20 |
| 434 | IKLLAADAGKPPLNQ | 20 |
| 580 | PENLPRHGTVGLITV | 20 |
| 696 | FQVIAVDNDTGMNAE | 20 |
| 803 | VSSPTSDYVKILVAA | 20 |
| 861 | NRQMIMMKKKKKKKK | 20 |
| 908 | PIDLEEQTMGKYNWV | 20 |
| 928 | FKPDSPDLARHYKSA | 20 |
| 104 | EHCFYEVEVAILPDE | 19 |
| 109 | EVEVAILPDEIFRLV | 19 |
| 117 | DEIFRLVKIRFLIED | 19 |
| 182 | QNIFGLDVIETPEGD | 19 |
| 186 | GLDVIETPEGDKMPQ | 19 |
| 190 | IETPEGDKMPQLIVQ | 19 |
| 198 | MPQLIVQKELDREEK | 19 |
| 238 | SVTDTNDNHPVFKET | 19 |
| 305 | TTGLITIKEPLDREE | 19 |
| 331 | DGGLMPARAMVLVNV | 19 |
| 415 | QFLLETAAYLDYEST | 19 |
| 421 | AAYLDYESTKEYAIK | 19 |
| 452 | LFIKVKDENDNAPVF | 19 |
| 518 | RTGMLTVVKKLDREK | 19 |

TABLE XLVII-continued

109P1D4v.1-DRBI 0301-15-mers
Each peptide is a portion of SEQ ID NO: 3; each start position is specified, the length of peptide is 15 amino acids, and the end posiflon for each peptide is the start position plus fourteen

| | | |
|---|---|---|
| 519 | TGMLTVVKKLDREKE | 19 |
| 567 | SPVFTHNEYNFYVPE | 19 |
| 588 | TVGLITVTDPDYGDN | 19 |
| 682 | YELVLPSTNPGTVVF | 19 |
| 712 | RYSIVGGNTRDLFAI | 19 |
| 730 | TGNITLMEKCDVTDL | 19 |
| 746 | LHRVLVKANDLGQPD | 19 |
| 791 | EAPVTPNTEIADVSS | 19 |
| 831 | TAVVRCRQAPHLKAA | 19 |
| 839 | APHLKAAQKNKQNSE | 19 |
| 862 | RQMIMMKKKKKKKKH | 19 |
| 864 | MIMMKKKKKKKHSP | 19 |

TABLE XLVIII

109P1D4v.1-DRB1 0401-15-mers
Each peptide is a portion of SEQ ID NO: 3; each start position is specified, the length of peptide is 15 amino acids, and the end position for each peptide is the start position plus fourteen

| | | |
|---|---|---|
| 173 | VQNYELIKSQNIFGL | 28 |
| 285 | HFSFSNLVSNIARRL | 28 |
| 510 | PPEFSLDCRTGMLTV | 28 |
| 613 | NDDFTIDSQTGVIRP | 28 |
| 916 | MGKYNWVTTPTTFKP | 28 |
| 40 | IGDLLKDLNLSLIPN | 26 |
| 46 | DLNLSLIPNKSLTTA | 26 |
| 54 | NKSLTTAMQFKLVYK | 26 |
| 125 | IRELIEDINONAPLE | 26 |
| 167 | DVGINGVQNYELIKS | 26 |
| 354 | SIDIRYIVNPVNDTV | 26 |
| 544 | DNGVPPLTSNVTVFV | 26 |
| 555 | TVFVSIIDQNDNSPV | 26 |
| 704 | DTGMNAEVRYSIVGG | 26 |
| 765 | VVIVNLFVNESVTNA | 26 |
| 779 | ATLINELVRKSTEAP | 26 |
| 797 | NTEIADVSSPTSDYV | 26 |

TABLE XLVIII-continued

109P1D4v.1-DRB1 0401-15-mers
Each peptide is a portion of SEQ
ID NO: 3; each start position is
specified, the length of peptide is
15 amino acids, and the end
position for each peptide is the
start position plus fourteen

| 823 | TVVVVIFITAVVRCR | 26 |
| 827 | VIFITAVVRCRQAPH | 26 |
| 893 | ADDVDSDGNRVTLDL | 26 |
| 963 | IQELPLDNTFVACDS | 26 |
| 7 | TYIFAVLLACVVFHS | 22 |
| 16 | CVVFHSGAQEKNYTI | 22 |
| 104 | EHCFYEVEVAILPDE | 22 |
| 117 | DEIFRLVKIRFLIED | 22 |
| 124 | KIRFLIEDINDNAPL | 22 |
| 297 | RRLFHLNATTGLITI | 22 |
| 413 | SNQFLLETAAYLDYE | 22 |
| 467 | TQSFVTVSIPENNSP | 22 |
| 628 | NISFDREKQESYTFY | 22 |
| 670 | KPVFIVPPSNCSYEL | 22 |
| 679 | NCSYELVLPSTNPGT | 22 |
| 721 | RDLFAIDQETGNITL | 22 |
| 768 | VNLFVNESVTNATLI | 22 |
| 807 | TSDYVKILVAAVAGT | 22 |
| 882 | LLNFVTIEETKADDV | 22 |
| 918 | KYNWVTTPTTFKPDS | 22 |
| 925 | PTTFKPDSPDLARHY | 22 |
| 936 | ARHYKSASPQPAFQI | 22 |
| 969 | DNTFVACDSISKCSS | 22 |
| 998 | VTTFEVPVSVHTRPV | 22 |
| 6 | GTYIFAVLLACVVFH | 20 |
| 27 | NYTIREEMPENVLIG | 20 |
| 36 | ENVLIGDLLKDLNLS | 20 |
| 37 | NVLIGDLLKDLNLSL | 20 |
| 41 | GDLLKDLNLSLIPNK | 20 |
| 48 | NLSLIPNKSLTTAMQ | 20 |
| 97 | CAGIPRDEHCFYEVE | 20 |
| 111 | EVAILPDEIFRLVKI | 20 |
| 112 | VAILPDEIFRLVKIR | 20 |
| 122 | LVKIRFLIEDINDNA | 20 |
| 135 | NAPLFPATVINISIP | 20 |
| 140 | PATVINISIPENSAI | 20 |
| 143 | VINISIPENSAINSK | 20 |
| 157 | KYTLPAAVDPDVGIN | 20 |
| 181 | SQNIFGLDVIETPEG | 20 |
| 184 | IFGLDVIETPEGDKM | 20 |
| 231 | STAILQVSVTDTNDN | 20 |
| 232 | TAILQVSVTDTNDNH | 20 |
| 234 | ILQVSVTDTNDNHPV | 20 |
| 245 | NHPVFKETEIEVSIP | 20 |
| 253 | EIEVSIPENAPVGTS | 20 |
| 265 | GTSVTQLHATDADIG | 20 |
| 281 | NAKIHFSFSNLVSNI | 20 |
| 289 | SNLVSNIARRLFHLN | 20 |
| 312 | KEPLDREETPNHKLL | 20 |
| 322 | NHKLLVLASDGGLMP | 20 |
| 323 | HKLLVLASDGGLMPA | 20 |
| 331 | DGGLMPARAMVLVNV | 20 |
| 337 | ARAMVLVNVTDVNDN | 20 |
| 338 | RAMVLVNVTDVNDNV | 20 |
| 349 | NDNVPSIDIRYIVNP | 20 |
| 357 | IRYIVNPVNDTVVLS | 20 |
| 358 | RYIVNPVNDTVVLSE | 20 |
| 365 | NDTVVLSENIPLNTK | 20 |
| 366 | DTVVLSENIPLNTKI | 20 |
| 377 | NTKIALITVTDKDAD | 20 |
| 379 | KIALITVTDKDADHN | 20 |
| 393 | NGRVTCFTDHEIPFR | 20 |
| 405 | PFRLRPVFSNQFLLE | 20 |
| 421 | AAYLDYESTKEYAIK | 20 |
| 472 | TVSIPENNSPGIQLT | 20 |
| 482 | GIQLTKVSAMOADSG | 20 |
| 488 | VSAMDADSGPNAKIN | 20 |
| 498 | NAKINYLLGPDAPPE | 20 |
| 522 | LTVVKKLDREKEDKY | 20 |
| 534 | DKYLFTILAKDNGVP | 20 |
| 547 | VPPLTSNVTVFVSII | 20 |
| 551 | TSNVTVFVSIIDQND | 20 |

TABLE XLVIII-continued

109P1D4v.1-DRB1 0401-15-mers
Each peptide is a portion of SEQ ID NO: 3; each start position is specified, the length of peptide is 15 amino acids, and the end position for each peptide is the start position plus fourteen

| Start | Peptide | Score |
|---|---|---|
| 558 | VSIIDQNDNSPVFTH | 20 |
| 580 | PENLPRHGTVGLITV | 20 |
| 606 | TLSILDENDDFTIDS | 20 |
| 640 | TFYVKAEDGGRVSRS | 20 |
| 648 | GGRVSRSSSAKVTIN | 20 |
| 658 | KVTINVVDVNDNKPV | 20 |
| 661 | INVVDVNDNKPVFIV | 20 |
| 682 | YELVLPSTNPGTVVF | 20 |
| 692 | GTVVFQVIAVDNDTG | 20 |
| 695 | VFQVIAVDNDTGMNA | 20 |
| 696 | FQVIAVDNDTGMNAE | 20 |
| 698 | VIAVDNDTGMNAEVR | 20 |
| 712 | RYSIVGGNTRDLFAI | 20 |
| 720 | TRDLFAIDQETGNIT | 20 |
| 723 | LFAIDQETGNITLME | 20 |
| 738 | KCDVTDLGLHRVLVK | 20 |
| 743 | DLGLHRVLVKANDLG | 20 |
| 747 | HRVLVKANDLGQPDS | 20 |
| 753 | ANDLGQPDSLFSVVI | 20 |
| 759 | PDSLFSVVIVNLFVN | 20 |
| 762 | LFSVVIVNLFVNESV | 20 |
| 764 | SVVIVNLFVNESVTN | 20 |
| 767 | IVNLFVNESVTNATL | 20 |
| 769 | NLFVNESVTNATLIN | 20 |
| 778 | NATLINELVRKSTEA | 20 |
| 800 | IADVSSPTSDYVKIL | 20 |
| 808 | SDYVKILVAAVAGTI | 20 |
| 810 | YVKILVAAVAGTITV | 20 |
| 811 | VKILVAAVAGTITVV | 20 |
| 812 | KILVAAVAGTITVVV | 20 |
| 815 | VAAVAGTITVVVIF | 20 |
| 819 | AGTITVVVIFITAV | 20 |
| 821 | TITVVVVIFITAVVR | 20 |
| 822 | ITVVVVIFITAVVRC | 20 |
| 839 | APHLKAAQKNKQNSE | 20 |
| 879 | KNLLLNFVTIEETKA | 20 |
| 880 | NLLLNFVTIEETKAD | 20 |
| 883 | LNFVTIEETKADDVD | 20 |
| 900 | GNRVTLDLPIDLEEQ | 20 |
| 904 | TLDLPIDLEEQTMGK | 20 |
| 906 | DLPIDLEEQTMGKYN | 20 |
| 947 | AFQIQPETPLNSKHH | 20 |
| 959 | KHHIIQELPLDNTFV | 20 |
| 960 | HHIIQELPLDNTFVA | 20 |
| 975 | CDSISKCSSSSSDPY | 20 |
| 995 | GYPVTTFEVPVSVHT | 20 |
| 12 | VLLACVVFHSGAQEK | 18 |
| 13 | LLACVVFHSGAQEKN | 18 |
| 19 | FHSGAQEKNYTIREE | 18 |
| 51 | LIPNKSLTTAMQFKL | 18 |
| 73 | PLIRIEEDTGEIFTT | 18 |
| 78 | EEDTGEIFTTGARID | 18 |
| 85 | FTTGARIDREKLCAG | 18 |
| 113 | AILPDEIFRLVKIRF | 18 |
| 137 | PLFPATVINISIPEN | 18 |
| 144 | INISIPENSAINSKY | 18 |
| 148 | IPENSAINSKYTLPA | 18 |
| 196 | DKMPQLIVQKELDRE | 18 |
| 201 | LIVQKELDREEKDTY | 18 |
| 220 | KVEDGGFPQRSSTAI | 18 |
| 228 | QRSSTAILQVSVTDT | 18 |
| 258 | IPENAPVGTSVTQLH | 18 |
| 262 | APVGTSVTQLHATDA | 18 |
| 282 | AKIHFSFSNLVSNIA | 18 |
| 293 | SNIARRLFHLNATTG | 18 |
| 298 | RLFHLNATTGLITIK | 18 |
| 309 | ITIKEPLDREETPNH | 18 |
| 341 | VLVNVTDVNDNVPSI | 18 |
| 346 | TDVNDNVPSIDIRYI | 18 |
| 350 | DNVPSIDIRYIVNPV | 18 |
| 363 | PVNDTVVLSENIPLN | 18 |
| 370 | LSENIPLNTKIALIT | 18 |

TABLE XLVIII-continued

109P1D4v.1-DRB1 0401-15-mers
Each peptide is a portion of SEQ ID NO: 3; each start position is specified, the length of peptide is 15 amino acids, and the end position for each peptide is the start position plus fourteen

| Start | Peptide | Score |
|---|---|---|
| 385 | VTDKDADHNGRVTCF | 18 |
| 406 | FRLRPVFSNQFLLET | 18 |
| 440 | DAGKPPLNQSAMLFI | 18 |
| 452 | LFIKVKDENDNAPVF | 18 |
| 460 | NDNAPVFTQSFVTVS | 18 |
| 464 | PVFTQSFVTVSIPEN | 18 |
| 487 | KVSAMDADSGPNAKI | 18 |
| 531 | EKEDKYLFTILAKDN | 18 |
| 556 | VFVSIIDQNDNSPVF | 18 |
| 568 | PVFTHNEYNFYVPEN | 18 |
| 577 | FYVPENLPRHGTVGL | 18 |
| 595 | TDPDYGDNSAVTLSI | 18 |
| 598 | DYGDNSAVTLSILDE | 18 |
| 609 | ILDENDDFTIDSQTG | 18 |
| 618 | IDSQTGVIRPNISFD | 18 |
| 625 | IRPNISFDREKQESY | 18 |
| 645 | AEDGGRVSRSSSAKV | 18 |
| 659 | VTINVVDVNDNKPVF | 18 |
| 689 | TNPGTVVFQVIAVDN | 18 |
| 740 | DVTDLGLHRVLVKAN | 18 |
| 750 | LVKANDLGQPDSLFS | 18 |
| 756 | LGQPDSLFSVVIVNL | 18 |
| 761 | SLFSVVIVNLFVNES | 18 |
| 770 | LFVNESVTNATLINE | 18 |
| 775 | SVTNATLINELVRKS | 18 |
| 796 | PNTEIADVSSPTSDY | 18 |
| 813 | ILVAAVAGTITVVVV | 18 |
| 833 | VVRCRQAPHLKAAQK | 18 |
| 838 | QAPHLKAAQKNKQNS | 18 |
| 854 | WATPNPENRQMIMMK | 18 |
| 876 | HSPKNLLLNFVTIEE | 18 |
| 890 | ETKADDVDSDGNRVT | 18 |
| 907 | LPIDLEEQTMGKYNW | 18 |
| 929 | KPDSPDLARHYKSAS | 18 |
| 930 | PDSPDLARHYKSASP | 18 |
| 962 | IIQELPLDNTFVACD | 18 |
| 992 | SDCGYPVTTFEVPVS | 18 |
| 1001 | FEVPVSVHTRPVGIQ | 18 |
| 223 | DGGFPQRSSTAILQV | 17 |
| 5 | SGTYIFAVLLACVVF | 16 |
| 60 | AMQFKLVYKTGDVPL | 16 |
| 64 | KLVYKTGDVPLIRIE | 16 |
| 82 | GEIFTTGARIDREKL | 16 |
| 105 | HCFYEVEVAILPDEI | 16 |
| 136 | APLFPATVINISIPE | 16 |
| 182 | QNIFGLDVIETPEGD | 16 |
| 246 | HPVFKETEIEVSIPE | 16 |
| 283 | KIHFSFSNLVSNIAR | 16 |
| 356 | DIRYIVNPVNDTVVL | 16 |
| 409 | RPVFSNQFLLETAAY | 16 |
| 420 | TAAYLDYESTKEYAI | 16 |
| 423 | YLDYESTKEYAIKLI | 16 |
| 450 | AMLFIKVKDENDNAP | 16 |
| 463 | APVFTQSFVTVSIPE | 16 |
| 535 | KYLFTILAKDNGVPP | 16 |
| 554 | VTVFVSIIDQNDNSP | 16 |
| 572 | HNEYNFYVPENLPRH | 16 |
| 574 | EYNFYVPENLPRHGT | 16 |
| 575 | YNFYVPENLPRHGTV | 16 |
| 596 | DPDYGDNSAVTLSIL | 16 |
| 639 | YTFYVKAEDGGRVSR | 16 |
| 693 | TVVFQVIAVDNDTGM | 16 |
| 710 | EVRYSIVGGNTRDLF | 16 |
| 760 | DSLFSVVIVNLFVNE | 16 |
| 826 | VVIFITAVVRCRQAP | 16 |
| 945 | QPAFQIQPETPLNSK | 16 |
| 151 | NSAINSKYTLPAAVD | 15 |
| 953 | ETPLNSKHHIIQELP | 15 |
| 1 | MDLLSGTYIFAVLLA | 14 |
| 9 | IFAVLLACVVFHSGA | 14 |
| 10 | FAVLLACVVFHSGAQ | 14 |
| 11 | AVLLACVVFHSGAQE | 14 |

TABLE XLVIII-continued

109P1D4v.1-DRB1 0401-15-mers
Each peptide is a portion of SEQ ID NO: 3; each start position is specified, the length of peptide is 15 amino acids, and the end position for each peptide is the start position plus fourteen

| Start | Peptide | Length |
|---|---|---|
| 15 | ACVVFHSGAQEKNYT | 14 |
| 44 | LKDLNLSLIPNKSLT | 14 |
| 63 | FKLVYKTGDVPLIRI | 14 |
| 69 | TGDVPLIRIEEDTGE | 14 |
| 71 | DVPLIRIEEDTGEIF | 14 |
| 72 | VPLIRIEEDTGEIFT | 14 |
| 74 | LIRIEEDTGEIFTTG | 14 |
| 88 | GARIDREKLCAGIPR | 14 |
| 107 | FYEVEVAILPDEIFR | 14 |
| 109 | EVEVAILPDEIFRLV | 14 |
| 116 | PDEIFRLVKIRFLIE | 14 |
| 119 | IFRLVKIRFLIEDIN | 14 |
| 126 | RFLIEDINDNAPLFP | 14 |
| 141 | ATVINISIPENSAIN | 14 |
| 145 | NISIPENSAINSKYT | 14 |
| 161 | PAAVDPDVGINGVQN | 14 |
| 170 | INGVQNYELIKSQNI | 14 |
| 175 | NYELIKSQNIFGLDV | 14 |
| 176 | YELIKSQNIFGLDVI | 14 |
| 186 | GLDVIETPEGDKMPQ | 14 |
| 187 | LDVIETPEGDKMPQL | 14 |
| 195 | GDKMPQLIVQKELDR | 14 |
| 200 | QLIVQKELDREEKDT | 14 |
| 204 | QKELDREEKDTYVMK | 14 |
| 213 | DTYVMKVKVEDGGFP | 14 |
| 216 | VMKVKVEDGGFPQRS | 14 |
| 251 | ETEIEVSIPENAPVG | 14 |
| 255 | EVSIPENAPVGTSVT | 14 |
| 261 | NAPVGTSVTQLHATD | 14 |
| 288 | FSNLVSNIARRLFHL | 14 |
| 296 | ARRLFHLNATTGLIT | 14 |
| 299 | LFHLNATTGLITIKE | 14 |
| 305 | TTGLITIKEPLDREE | 14 |
| 324 | KLLVLASDGGLMPAR | 14 |
| 325 | LLVLASDGGLMPARA | 14 |
| 339 | AMVLVNVTDVNDNVP | 14 |
| 340 | MVLVNVTDVNDNVPS | 14 |
| 342 | LVNVTDVNDNVPSID | 14 |
| 367 | TVVLSENIPLNTKIA | 14 |
| 371 | SENIPLNTKIALITV | 14 |
| 415 | QFLLETAAYLDYEST | 14 |
| 431 | EYAIKLLAADAGKPP | 14 |
| 433 | AIKLLAADAGKPPLN | 14 |
| 434 | IKLLAADAGKPPLNQ | 14 |
| 443 | KPPLNQSAMLFIKVK | 14 |
| 448 | QSAMLFIKVKDENDN | 14 |
| 453 | FIKVKDENDNAPVFT | 14 |
| 462 | NAPVFTQSFVTVSIP | 14 |
| 468 | QSFVTVSIPENNSPG | 14 |
| 470 | FVTVSIPENNSPGIQ | 14 |
| 480 | SPGIQLTKVSAMDAD | 14 |
| 502 | NYLLGPDAPPEFSLD | 14 |
| 518 | RTGMLTVVKKLDREK | 14 |
| 519 | TGMLTVVKKLDREKE | 14 |
| 525 | VKKLDREKEDKYLFT | 14 |
| 538 | FTILAKDNGVPPLTS | 14 |
| 553 | NVTVFVSIIDQNDNS | 14 |
| 586 | HGTVGLITVTDPDYG | 14 |
| 588 | TVGLITVTDPDYGDN | 14 |
| 591 | LITVTDPDYGDNSAV | 14 |
| 602 | NSAVTLSILDENDDF | 14 |
| 604 | AVTLSILDENDDFTI | 14 |
| 607 | LSILDENDDFTIDSQ | 14 |
| 622 | TGVIRPNISFDREKQ | 14 |
| 626 | RPNISFDREKQESYT | 14 |
| 656 | SAKVTINVVDVNDNK | 14 |
| 660 | TINVVDVNDNKPVFI | 14 |
| 663 | VVDVNDNKPVFIVPP | 14 |
| 669 | NKPVFIVPPSNCSYE | 14 |
| 671 | PVFIVPPSNCSYELV | 14 |
| 681 | SYELVLPSTNPGTVV | 14 |
| 683 | ELVLPSTNPGTVVFQ | 14 |

TABLE XLVIII-continued

109P1D4v.1-DRB1 0401-15-mers
Each peptide is a portion of SEQ
ID NO: 3; each start position is
specified, the length of peptide is
15 amino acids, and the end
position for each peptide is the
start position plus fourteen

| | | |
|---|---|---|
| 708 | NAEVRYSIVGGNTRD | 14 |
| 713 | YSIVGGNTRDLFAID | 14 |
| 730 | TGNITLMEKCDVTDL | 14 |
| 733 | ITLMEKCDVTDLGLH | 14 |
| 741 | VTDLGLHRVLVKAND | 14 |
| 773 | NESVTNATLINELVR | 14 |
| 783 | NELVRKSTEAPVTPN | 14 |
| 824 | VVVVIFITAVVRCRQ | 14 |
| 830 | ITAVVRCRQAPHLKA | 14 |
| 861 | NRQMIMMKKKKKKKK | 14 |
| 885 | FVTIEETKADDVDSD | 14 |
| 913 | EQTMGKYNWVTTPTT | 14 |
| 919 | YNWVTTPTTFKPDSP | 14 |
| 932 | SPDLARHYKSASPQP | 14 |
| 970 | NTFVACDSISKCSSS | 14 |
| 988 | PYSVSDCGYPVTTFE | 14 |
| 1000 | TFEVPVSVHTRPVGI | 14 |
| 1002 | EVPVSVHTRPVGIQV | 14 |

TABLE XLIX

109P1D4v.1-DRB1 1101-15-mers
Each peptide is a portion of SEQ
ID NO: 3; each start position is
specified, the length of peptide is
15 amino acids, and the end
position for each peptide is the
start position plus fourteen

| | | |
|---|---|---|
| 535 | KYLFTILAKDNGVPP | 32 |
| 827 | VIFITAVVRCRQAPH | 26 |
| 116 | PDEIFRLVKIRFLIE | 25 |
| 285 | HFSFSNLVSNIARRL | 25 |
| 1000 | TFEVPVSVHTRPVGI | 25 |
| 60 | AMQFKLVYKTGDVPL | 24 |
| 518 | RTGMLTVVKKLDREK | 23 |
| 519 | TGMLTVVKKLDREKE | 23 |
| 882 | LLNFVTIEETKADDV | 23 |
| 289 | SNLVSNIARRLFHLN | 22 |
| 636 | QESYTFYVKAEDGGR | 22 |
| 730 | TGNITLMEKCDVTDL | 22 |

TABLE XLIX-continued

109P1D4v.1-DRB1 1101-15-mers
Each peptide is a portion of SEQ
ID NO: 3; each start position is
specified, the length of peptide is
15 amino acids, and the end
position for each peptide is the
start position plus fourteen

| | | |
|---|---|---|
| 779 | ATLINELVRKSTEAP | 22 |
| 1002 | EVPVSVHTRPVGIQV | 22 |
| 12 | VLLACVVFHSGAQEK | 21 |
| 37 | NVLIGDLLKDLNLSL | 21 |
| 342 | LVNVTDVNDNVPSID | 21 |
| 522 | LTVVKKLDREKEDKY | 21 |
| 808 | SDYVKILVAAVAGTI | 21 |
| 861 | NRQMIMMKKKKKKKK | 21 |
| 11 | AVLLACVVFHSGAQE | 20 |
| 82 | GEIFTTGARIDREKL | 20 |
| 105 | HCFYEVEVAILPDEI | 20 |
| 212 | KDTYVMKVKVEDGGF | 20 |
| 265 | GTSVTQLHATDADIG | 20 |
| 293 | SNIARRLFHLNATTG | 20 |
| 479 | NSPGIQLTKVSAMDA | 20 |
| 482 | GIQLTKVSAMDADSG | 20 |
| 645 | AEDGGRVSRSSSAKV | 20 |
| 932 | SPDLARHYKSASPDP | 20 |
| 972 | FVACDSISKCSSSSS | 20 |
| 136 | APLFPATVINISIPE | 19 |
| 184 | IFGLDVIETPEGDKM | 19 |
| 296 | ARRLFHLNATTGLIT | 19 |
| 322 | NHKLLVLASDGGLMP | 19 |
| 463 | APVFTQSFVTVSIPE | 19 |
| 660 | TINVVDVNDNKPVFI | 19 |
| 720 | TRDLFAIDQETGNIT | 19 |
| 821 | TITVVVVIFITAVVR | 19 |
| 7 | TYIFAVLLACVVFHS | 18 |
| 71 | DVPLIRIEEDTGEIF | 18 |
| 126 | RFLIEDINDNAPLFP | 18 |
| 155 | NSKYTLPAAVDPDVG | 18 |
| 182 | QNIFGLDVIETPEGD | 18 |
| 213 | DTYVMKVKVEDGGFP | 18 |
| 379 | KIALITVTDKDADHN | 18 |
| 431 | EYAIKLLAADAGKPP | 18 |
| 485 | LTKVSAMDADSGPNA | 18 |

TABLE XLIX-continued

109P1D4v.1-DRB1 1101-15-mers
Each peptide is a portion of SEQ ID NO: 3; each start position is specified, the length of peptide is 15 amino acids, and the end position for each peptide is the start position plus fourteen

| | | |
|---|---|---|
| 498 | NAKINYLLGPDAPPE | 18 |
| 510 | PPEFSLDCRTGMLTV | 18 |
| 586 | HGTVGLITVTDPDYG | 18 |
| 695 | VFQVIAVDNDTGMNA | 18 |
| 760 | DSLFSVVIVNLFVNE | 18 |
| 764 | SVVIVNLFVNESVTN | 18 |
| 797 | NTEIADVSSPTSDYV | 18 |
| 993 | DCGYPVTTFEVPVSV | 18 |
| 104 | EHCFYEVEVAILPDE | 17 |
| 117 | DEIFRLVKIRFLIED | 17 |
| 210 | EEKDTYVMKVKVEDG | 17 |
| 246 | HPVFKETEIEVSIPE | 17 |
| 380 | IALITVTDKDADHNG | 17 |
| 449 | SAMLFIKVKDENDNA | 17 |
| 638 | SYTFYVKAEDGGRVS | 17 |
| 670 | KPVFIVPPSNCSYEL | 17 |
| 693 | TVVFQVIAVDNDTGM | 17 |
| 744 | LGLHRVLVKANDLGQ | 17 |
| 819 | AGTITVVVIFITAV | 17 |
| 925 | PTTFKPDSPDLARHY | 17 |
| 986 | SDPYSVSDCGYPVTT | 17 |
| 138 | LFPATVINISIPENS | 16 |
| 173 | VQNYELIKSQNIFGL | 16 |
| 399 | FTDHEIPFRLRPVFS | 16 |
| 450 | AMLFIKVKDENDNAP | 16 |
| 467 | TQSFVTVSIPENNSP | 16 |
| 500 | KINYLLGPDAPPEFS | 16 |
| 554 | VTVFVSIIDQNDNSP | 16 |
| 618 | IDSQTGVIRPNISFD | 16 |
| 679 | NCSYELVLPSTNPGT | 16 |
| 689 | TNPGTVVFQVIAVDN | 16 |
| 704 | DTGMNAEVRYSIVGG | 16 |
| 710 | EVRYSIVGGNTRDLF | 16 |
| 738 | KCDVTDLGLHRVLVK | 16 |
| 768 | VNLFVNESVTNATLI | 16 |
| 807 | TSDYVKILVAAVAGT | 16 |

TABLE XLIX-continued

109P1D4v.1-DRB1 1101-15-mers
Each peptide is a portion of SEQ ID NO: 3; each start position is specified, the length of peptide is 15 amino acids, and the end position for each peptide is the start position plus fourteen

| | | |
|---|---|---|
| 916 | MGKYNWVTTPTTFKP | 16 |
| 936 | ARHYKSASPQPAFQI | 16 |

TABLE XXII

109P1D4 v.2 C' Terminal-A1 9-mers
Each peptide is a portion of SEQ ID NO: 5; each start position is specified, the length of peptide is 9 amino acids, and the end postion for each peptide is the start position plus eight

| | | |
|---|---|---|
| 8 | PTDSRTSTI | 16 |
| 5 | HTRPTDSRT | 10 |
| 12 | RTSTIEICS | 10 |
| 10 | DSRTSTIEI | 8 |
| 4 | STIEIDSEI | 8 |

TABLE XXIII

109P1D4v.2 C' Terminal-A0201 9-mers
Each peptide is a portion of SEQ ID NO: 5; each start position is specified, the length of peptide is 9 amino acids, and the end position for each peptide is the start position plus eight

| | | |
|---|---|---|
| 14 | STIEICSEI | 20 |
| 8 | PTDSRTSTI | 13 |
| 10 | DSRTSTIEI | 11 |
| 5 | HTRPTDSRT | 10 |

TABLE XXIV

109P1D4v.2 C' Terminal A0203-9-mers

No Results Found.

TABLE XXV

109P1D4 v.2
C' Terminal-A3 9-mers
Each peptide is a portion of SEQ ID NO: 5;
each start position is specified, the length
of peptide is 9 amino acids, and the end position
for each peptide is the start position plus eight

| | | |
|---|---|---|
| 3 | SVHTRPTDS | 15 |
| 1 | PVSVHTRPT | 10 |
| 4 | VHTRPTDSR | 9 |
| 5 | HTRPTDSRT | 9 |
| 7 | RPTDSRTST | 9 |
| 8 | PTDSRTSTI | 9 |
| 14 | STIEICSEI | 8 |

TABLE XXVI

109P1D4 v.2
C' Terminal-A26 9-mers
Each peptide is a portion of SEQ ID NO: 5;
each start position is specified, the length
of peptide is 9 amino acids, and the end position
for each peptide is the start position plus eight

| | | |
|---|---|---|
| 14 | STIEICSEI | 18 |
| 3 | SVHTRPTDS | 11 |
| 8 | PTDSRTSTI | 11 |
| 12 | RTSTIEICS | 11 |
| 1 | PVSVHTRPT | 10 |
| 5 | HTRPTDSRT | 10 |
| 10 | DSRTSTIEI | 9 |

TABLE XXVII

109P1D4v.2
C'Terminal-B0702 9-mers
Each peptide is a portion of SEQ ID NO: 5;
each start position is specified, the length
of peptide is 9 amino acids, and the end position
for each peptide is the start position plus eight

| | | |
|---|---|---|
| 7 | RPTDSRTST | 19 |
| 1 | PVSVHTRPT | 10 |
| 5 | HTRPTDSRT | 9 |
| 10 | DSRTSTIEI | 9 |

TABLE XXVIII

109P1D4v.2
C'Terminal-B08 9-mers
Each peptide is a portion of SEQ ID NO: 5;
each start position is specified, the length
of peptide is 9 amino acids, and the end position
for each peptide is the start position plus eight

| | | |
|---|---|---|
| 8 | PTDSRTSTI | 14 |
| 10 | DSRTSTIEI | 13 |

TABLE XXVIII-continued

109P1D4v.2
C'Terminal-B08 9-mers
Each peptide is a portion of SEQ ID NO: 5;
each start position is specified, the length
of peptide is 9 amino acids, and the end position
for each peptide is the start position plus eight

| | | |
|---|---|---|
| 14 | STIEICSEI | 11 |
| 3 | SVHTRPTDS | 10 |
| 5 | HTRPTDSRT | 7 |

TABLE XXIX

109P1D4v.2
C' Terminal-B1510-9-mers
Each peptide is a portion of SEQ ID NO: 5;
each start position is specified, the length
of peptide is 9 amino acids, and the end position
for each peptide is the start position plus eight

| | | |
|---|---|---|
| 4 | VHTRPTDSR | 11 |
| 1 | PVSVHTRPT | 4 |
| 5 | HTRPTDSRT | 4 |
| 6 | TRPTDSRTS | 4 |

TABLE XXX

109P1D4v.2
C' Terminal-B2705 9-mers
Each peptide is a portion of SEQ ID NO: 5;
each start position is specified, the length
of peptide is 9 amino acids, and the end position
for each peptide is the start position plus eight

| | | |
|---|---|---|
| 11 | SRTSTIEIC | 13 |
| 4 | VHTRPTDSR | 12 |
| 6 | TRPTDSRTS | 12 |
| 14 | STIEICSEI | 12 |
| 10 | DSRTSTIEI | 9 |
| 7 | RPTDSRTST | 8 |
| 8 | PTDSRTSTI | 8 |

TABLE XXXI

109P1D4v.2
C' Terminal-B2709 9-mers
Each peptide is a portion of SEQ ID NO: 5;
each start position is specified, the length
of peptide is 9 amino acids, and the end position
for each peptide is the start position plus eight
Each peptide is a portion of SEQ ID NO: 5;
each start position is specified, the length
of peptide is 9 amino acids, and the end position
for each peptide is the start position plus eight

| | | |
|---|---|---|
| 11 | SRTSTIEIC | 13 |
| 6 | TRPTDSRTS | 11 |
| 14 | STIEICSEI | 10 |

TABLE XXXI-continued

109P1D4v.2
C' Terminal-B2709 9-mers
Each peptide is a portion of SEQ ID NO: 5;
each start position is specified, the length
of peptide is 9 amino acids, and the end position
for each peptide is the start position plus eight
Each peptide is a portion of SEQ ID NO: 5;
each start position is specified, the length
of peptide is 9 amino acids, and the end position
for each peptide is the start position plus eight

| | | |
|---|---|---|
| 8 | PTDSRTSTI | 9 |
| 10 | DSRTSTIEI | 8 |

TABLE XXXII

109P1D4v.2
C'Terminal-B4402 9-mers
Each peptide is a portion of SEQ ID NO: 5;
each start position is specified, the length
of peptide is 9 amino acids, and the end position
for each peptide is the start position plus eight

| | | |
|---|---|---|
| 14 | STIEICSEI | 13 |
| 8 | PTDSRTSTI | 12 |
| 10 | DSRTSTIEI | 11 |

TABLE XXXVI

109P1D4v.2 C' Terminal-A0203-10-mers

No Results Found.

TABLE XXXVII

109P1D4v.2
C' Terminal-A3-10-mers
Each peptide is a portion of SEQ ID NO: 5;
each start position is specified, the length
of peptide is 10 amino acids, and the end position
for each peptide is the start position plus nine

| | | |
|---|---|---|
| 4 | SVHTRPTDSR | 13 |
| 2 | PVSVHTRPTD | 15 |
| 8 | RPTDSRTSTI | 12 |
| 6 | HTRPTDSRTS | 10 |

TABLE XXXVIII

109P1D4v.2
C' terminal-A26-10-mers
Each peptide is a portion of SEQ ID NO: 5;
each start position is specified, the length
of peptide is 10 amino acids, and the end position
for each peptide is the start position plus nine

| | | |
|---|---|---|
| 13 | RTSTIEICSE | 13 |
| 4 | SVHTRPTDSR | 12 |
| 11 | DSRTSTIEIC | 12 |
| 2 | PVSVHTRPTD | 11 |

TABLE XXXVIII-continued

109P1D4v.2
C' terminal-A26-10-mers
Each peptide is a portion of SEQ ID NO: 5;
each start position is specified, the length
of peptide is 10 amino acids, and the end position
for each peptide is the start position plus nine

| | | |
|---|---|---|
| 6 | HTRPTDSRTS | 10 |
| 9 | PTDSRTSTIE | 9 |

TABLE XXXIX

109P1D4v.2
C'Terminal-B0702 10-mers
Each peptide is a portion of SEQ ID NO: 5;
each start position is specified, the length of
peptide is 10 amino acids, and the end position
for each peptide is the start position plus nine

| | | |
|---|---|---|
| 1 | VPVSVHTRPT | 18 |
| 8 | RPTDSRTSTI | 18 |
| 10 | TDSRTSTIEI | 9 |

TABLE XL

109P1D4v.2 C' Terminal B08-10-mers

No Results Found.

TABLE XXXIII

109P1D4v.2
C'Terminal-B5101 9-mers
Each peptide is a portion of SEQ ID NO: 5;
each start position is specified, the length of
peptide is 9 amino acids, and the end position
for each peptide is the start position plus eight

| | | |
|---|---|---|
| 10 | DSRTSTIEI | 17 |
| 7 | RPTDSRTST | 13 |
| 8 | PTDSRTSTI | 12 |
| 14 | STIEICSEI | 12 |

TABLE XXXIV

109P1D4v.2
C' Terminal-A1-10-mers
Each peptide is a portion of SEQ ID NO: 5;
each start position is specified, the length of
peptide is 10 amino acids, and the end position
for each peptide is the start position plus nine

| | | |
|---|---|---|
| 9 | PTDSRTSTIE | 16 |
| 6 | HTRPTDSRTS | 10 |

TABLE XXXV

109P1D4v.2
C'Terminal-A0201-10-mers
Each peptide is a portion of SEQ ID NO: 5;
each start position is specified, the length of
peptide is 10 amino acids, and the end position
for each peptide is the start position plus nine

| | | |
|---|---|---|
| 8 | RPTDSRTSTI | 10 |
| 10 | TDSRTSTIEI | 10 |
| 13 | RTSTIEICSE | 10 |
| 14 | TSTIEICSEI | 9 |
| 4 | SVHTRPTDSR | 8 |
| 6 | HTRPTDSRTS | 8 |
| 7 | TRPTDSRTST | 6 |
| 1 | VPVSVHTRPT | 5 |

TABLE XLI

109P1D4v.2 C' Terminal-B1510-10-mers

No Results Found.

TABLE XLII

109P1D4v.2 C' Terminal B2705-10-mers

No Results Found.

TABLE XLIII

109P1D4v.2 C' Terminal-B2709-10-mers

No Results Found.

TABLE XLIV

109P1D4v.2
C' Terminal-B4402-10-mers
Each peptide is a portion of SEQ ID NO: 5;
each start position is specified, the length of
peptide is 10 amino acids, and the end position
for each peptide is the start position plus nine

| | | |
|---|---|---|
| 10 | TDSRTSTIEI | 12 |
| 8 | RPTDSRTSTI | 11 |
| 14 | TSTIEICSEI | 8 |

TABLE XLV

109P1D4v.2 C' Terminal-B5101-10-mers

No Results Found.

TABLE XLVI

109P1D4v.2
C' Terminal-DRBI 0101 15-mers
Each peptide is a portion of SEQ ID NO: 5; each
start position is specified, the length of peptide
is 15 amino acids, and the end position for
each peptide is the start position plus fourteen

| | | |
|---|---|---|
| 3 | TFEVPVSVHTRPTDS | 17 |
| 9 | SVHTRPTDSRTSTIE | 17 |
| 1 | VTTFEVPVSVHTRPT | 16 |
| 6 | VPVSVHTRPTDSRTS | 16 |
| 11 | HTRPTDSRTSTIEIC | 15 |
| 4 | FEVPVSVHTRPTDSR | 14 |
| 7 | PVSVHTRPTDSRTST | 14 |
| 13 | RPTDSRTSTIEICSE | 14 |
| 5 | EVPVSVHTRPTDSRT | 8 |

TABLE XLVII

109P1D4v.2
C' Terminal-DRB1 0301 15-mers
Each peptide is a portion of SEQ ID NO: 5; each
start position is specified, the length of peptide
is 15 amino acids, and the end position for
each peptide is the start position plus fourteen

| | | |
|---|---|---|
| 10 | VHTRPTDSRTSTIEI | 17 |
| 5 | EVPVSVHTRPTDSRT | 16 |
| 7 | PVSVHTRPTDSRTST | 11 |
| 3 | TFEVPVSVHTRPTDS | 10 |
| 1 | VTTFEVPVSVHTRPT | 9 |

TABLE XLVIII

109P1D4v.2
C' Terminal-DRB1 0401 15-mers
Each peptide is a portion of SEQ ID NO: 5; each
start position is specified, the length of peptide
is 15 amino acids, and the end position for
each peptide is the start position plus fourteen

| | | |
|---|---|---|
| 1 | VTTFEVPVSVHTRPT | 22 |
| 4 | FEVPVSVHTRPTDSR | 18 |
| 10 | VHTRPTDSRTSTIEI | 18 |
| 3 | TFEVPVSVHTRPTDS | 14 |
| 5 | EVPVSVHTRPTDSRT | 14 |
| 9 | SVHTRPTDSRTSTIE | 12 |
| 11 | HTRPTDSRTSTIEIC | 12 |
| 13 | RPTDSRTSTIEICSE | 12 |

TABLE XLIX

109P1D4v.2
C' Terminal-DRB1 1101 15-mers
Each peptide is a portion of SEQ ID NO: 5; each start position is specified, the length of peptide is 15 amino acids, and the end position for each peptide is the start position plus fourteen

| | | |
|---|---|---|
| 3 | TFEVPVSVHTRPTDS | 25 |
| 5 | EVPVSVHTRPTDSRT | 15 |
| 1 | VTTFEVPVSVHTRPT | 13 |

TABLE XXII

109P1D4 v.2-
N' Terminal-A1-9-mers
Each peptide is a portion of SEQ ID NO: 5; each start position is specified, the length of peptide is 9 amino acids, and the end position for each peptide is the start position plus eight

| | | |
|---|---|---|
| 19 | LIQQTVTSV | 26 |
| 11 | QIFQVLCGL | 24 |
| 8 | VLIQIFQVL | 23 |
| 15 | VLCGLIQQT | 22 |
| 7 | WVLIQIFQV | 20 |
| 18 | GLIQQTVTS | 19 |
| 24 | VTSVPGMDL | 16 |
| 16 | LCGLIQQTV | 14 |
| 22 | QTVTSVPGM | 14 |
| 25 | TSVPGMDLL | 14 |
| 2 | RTERQWVLI | 13 |
| 9 | LIQIFQVLC | 13 |

TABLE XXIII

109P1D41 v.2
N' terminal-A0201 9-mers
Each peptide is a portion of SEQ ID NO: 5; each start position is specified, the length of peptide is 9 amino acids, and the end position for each peptide is the start position plus eight

| | | |
|---|---|---|
| 19 | LIQQTVTSV | 26 |
| 11 | QIFQVLCGL | 24 |
| 8 | VLIQIFQVL | 23 |
| 15 | VLCGLIQQT | 22 |
| 7 | WVLIQIFQV | 20 |
| 18 | GLIQQTVTS | 19 |
| 24 | VTSVPGMDL | 16 |
| 16 | LCGLIQQTV | 14 |
| 22 | QTVTSVPGM | 14 |
| 25 | TSVPGMDLL | 14 |

TABLE XXIII-continued

109P1D41 v.2
N' terminal-A0201 9-mers
Each peptide is a portion of SEQ ID NO: 5; each start position is specified, the length of peptide is 9 amino acids, and the end position for each peptide is the start position plus eight

| | | |
|---|---|---|
| 2 | RTERQWVLI | 13 |
| 9 | LIQIFQVLC | 13 |

TABLE XXIV

| 109P1D4v.2 N' terminal-A02039-mers |
|---|
| No Results Found. |

TABLE XXV

109P1D41 v.2
N' terminal-A3-9-mers
Each peptide is a portion of SEQ ID NO: 5; each start position is specified, the length of peptide is 9 amino acids, and the end position for each peptide is the start position plus eight

| | | |
|---|---|---|
| 18 | GLIQQTVTS | 21 |
| 14 | QVLCGLIQQ | 19 |
| 8 | VLIQIFQVL | 17 |
| 7 | WVLIQIFQV | 16 |
| 26 | SVPGMDLLS | 16 |
| 15 | VLCGLIQQT | 15 |
| 23 | TVTSVPGMD | 14 |
| 9 | LIQIFQVLC | 13 |
| 29 | GMDLLSGTY | 12 |
| 2 | RTERQWVLI | 11 |
| 11 | QIFQVLCGL | 11 |
| 19 | LIQQTVTSV | 11 |

TABLE XXVI

109P1D41v.2
N' terminal-A26-9-mers
Each peptide is a portion of SEQ ID NO: 5; each start position is specified, the length of peptide is 9 amino acids, and the end position for each peptide is the start position plus eight

| | | |
|---|---|---|
| 11 | QIFQVLCGL | 20 |
| 24 | VTSVPGMDL | 17 |
| 4 | ERQWVLIQI | 16 |
| 14 | QVLCGLIQQ | 16 |
| 22 | QTVTSVPGM | 16 |
| 7 | WVLIQIFQV | 15 |
| 23 | TVTSVPGMD | 15 |

TABLE XXVI-continued

109P1D41v.2
N' terminal-A26-9-mers
Each peptide is a portion of SEQ ID NO: 5;
each start position is specified, the length
of peptide is 9 amino acids, and the end position
for each peptide is the start position plus eight

| 8  | VLIQIFQVL | 14 |
| 25 | TSVPGMDLL | 14 |
| 5  | RQWVLIQIF | 13 |
| 29 | GMDLLSGTY | 13 |
| 26 | SVPGMDLLS | 12 |
| 17 | MRTERQWVL | 11 |

TABLE XXVII

109P1D4 v.2
N' terminal-B0702 9-mers
Each peptide is a portion of SEQ ID NO: 5;
each start position is specified, the length
of peptide is 9 amino acids, and the end position
for each peptide is the start position plus eight

| 24 | VTSVPGMDL | 16 |
| 27 | VPGMDLLSG | 13 |
| 8  | VLIQIFQVL | 12 |
| 1  | MRTERQWVL | 11 |
| 25 | TSVPGMDLL | 11 |
| 11 | QIFQVLCGL | 10 |
| 2  | RTERQWVLI | 9  |
| 15 | VLCGLIQQT | 8  |
| 17 | CGLIQQTVT | 8  |
| 19 | LIQQTVTSV | 8  |
| 22 | QTVTSVPGM | 8  |

TABLE XXVIII

109P1D4v.2
N' terminal-B08-9-mers
Each peptide is a portion of SEQ ID NO: 5;
each start position is specified, the length
of peptide is 9 amino acids, and the end position
for each peptide is the start position plus eight

| 1  | MRTERQWVL | 20 |
| 8  | VLIQIFQVL | 17 |
| 11 | QIFQVLCGL | 14 |
| 24 | VTSVPGMDL | 12 |
| 25 | TSVPGMDLL | 10 |

TABLE XXIX

109P1D4 v.2
N' terminal-B1510 9-mers
Each peptide is a portion of SEQ ID NO: 5;
each start position is specified, the length
of peptide is 9 amino acids, and the end position
for each peptide is the start position plus eight

| 25 | TSVPGMDLL | 15 |
| 1  | MRTERQWVL | 13 |
| 8  | VLIQIFQVL | 13 |
| 24 | VTSVPGMDL | 13 |
| 11 | QIFQVLCGL | 11 |
| 5  | RQWVLIQIF | 8  |
| 22 | QTVTSVPGM | 8  |

TABLE XXX

109P1D4 v.2
N' terminal-B2705 9-mers
Each peptide is a portion of SEQ ID NO: 5;
each start position is specified, the length
of peptide is 9 amino acids, and the end position
for each peptide is the start position plus eight

| 1  | MRTERQWVL | 25 |
| 4  | ERQWVLIQI | 20 |
| 5  | RQWVLIQIF | 18 |
| 11 | QIFQVLCGL | 17 |
| 8  | VLIQIFQVL | 16 |
| 29 | GMDLLSGTY | 15 |
| 25 | TSVPGMDLL | 14 |

TABLE XXXI

109P1D4 v.2
N' terminal-B2709 9-mers
Each peptide is a portion of SEQ ID NO: 5;
each start position is specified, the length
of peptide is 9 amino acids, and the end position
for each peptide is the start position plus eight

| 1  | MRTERQWVL | 21 |
| 4  | ERQWVLIQI | 19 |
| 2  | RTERQWVLI | 13 |
| 5  | RQWVLIQIF | 12 |
| 8  | VLIQIFQVL | 12 |
| 11 | QIFQVLCGL | 12 |
| 25 | TSVPGMDLL | 12 |
| 7  | WVLIQIFQV | 11 |
| 22 | QTVTSVPGM | 11 |

TABLE XXXII

109P1D4v.2
N' terminal-B4402-9-mers
Each peptide is a portion of SEQ ID NO: 5;
each start position is specified, the length
of peptide is 9 amino acids, and the end position
for each peptide is the start position plus eight

| | | |
|---|---|---|
| 8 | VLIQIFQVL | 16 |
| 25 | TSVPGMDLL | 14 |
| 4 | ERQWVLIQI | 13 |
| 5 | RQWVLIQIF | 13 |
| 11 | QIFQVLCGL | 13 |
| 29 | GMDLLSGTY | 13 |
| 1 | MRTERQWVL | 12 |
| 3 | TERQWVLIQ | 12 |
| 2 | RTERQWVLI | 11 |
| 24 | VTSVPGMDL | 11 |
| 12 | IFQVLCGLI | 9 |

TABLE XXXIII

109P1D4v.2
N' terminal-B5101-9-mers
Each peptide is a portion of SEQ ID NO: 5;
each start position is specified, the length
of peptide is 9 amino acids, and the end position
for each peptide is the start position plus eight

| | | |
|---|---|---|
| 4 | ERQWVLIQI | 14 |
| 19 | LIQQTVTSV | 14 |
| 27 | VPGMDLLSG | 13 |
| 1 | MRTERQWVL | 12 |
| 12 | IFQVLCGLI | 12 |
| 16 | LCGLIQQTV | 12 |
| 17 | CGLIQQTVT | 12 |
| 2 | RTERQWVLI | 11 |
| 7 | WVLIQIFQV | 11 |
| 8 | VLIQIFQVL | 11 |
| 11 | QIFQVLCGL | 10 |
| 20 | IQQTVTSVP | 8 |
| 28 | PGMDLLSGT | 8 |
| 24 | VTSVPGMDL | 7 |
| 25 | TSVPGMDLL | 7 |

TABLE XXXIV

109P1D4v.2-N' terminal-A1-10-mers
Each peptide is a portion of SEQ ID NO: 5;
each start position is specified, the length
of peptide is 10 amino acids, and the end position
for each peptide is the start position plus nine

| | | |
|---|---|---|
| 2 | RTERQWVLIQ | 23 |
| 25 | TSVPGMDLLS | 16 |
| 28 | PGMDLLSGTY | 15 |
| 29 | GMDLLSGTYI | 11 |

TABLE XXXV

109P1D4 v.2-N' terminal-A0201-10-mers
Each peptide is a portion of SEQ ID NO: 5;
each start position is specified, the length
of peptide is 10 amino acids, and the end position
for each peptide is the start position plus nine

| | | |
|---|---|---|
| 18 | GLIQQTVTSV | 29 |
| 15 | VLCGLIQQTV | 25 |
| 10 | IQIFQVLCGL | 18 |
| 11 | QIFQVLCGLI | 17 |
| 29 | GMDLLSGTYI | 17 |
| 7 | WVLIQIFQVL | 16 |
| 8 | VLIQIFQVLC | 15 |
| 9 | LIQIFQVLCG | 15 |
| 24 | VTSVPGMDLL | 15 |
| 26 | SVPGMDLLSG | 15 |

TABLE XXXVI

109P1D4v.2-N' terminal-A0203-10-mers

No Results Found.

TABLE XXXIX

109P1D4v.2
N' terminal-B0702-10mer
Each peptide is a portion of SEQ ID NO: 5;
each start position is specified, the length
of peptide is 10 amino acids, and the end position
for each peptide is the start position plus nine

| | | |
|---|---|---|
| 27 | VPGMDLLSGT | 17 |
| 7 | WVLIQIFQVL | 12 |
| 24 | VTSVPGMDLL | 12 |
| 10 | IQIFQVLCGL | 11 |
| 23 | TVTSVPGMDL | 10 |
| 16 | LCGLIQQTVT | 9 |
| 1 | MRTERQWVLI | 8 |
| 3 | TERQWVLIQI | 8 |

TABLE XXXIX-continued

109P1D4v.2
N' terminal-B0702-10mer
Each peptide is a portion of SEQ ID NO: 5;
each start position is specified, the length
of peptide is 10 amino acids, and the end position
for each peptide is the start position plus nine

| 15 | VLCGLIQQTV | 8 |
| --- | --- | --- |
| 18 | GLIQQTVTSV | 8 |
| 21 | QQTVTSVPGM | 8 |
| 29 | GMDLLSGTYI | 8 |

TABLE XXXVII

109P1D4v.2
N' terminal-A3-10-mers
Each peptide is a portion of SEQ ID NO: 5;
each start position is specified, the length
of peptide is 10 amino acids, and the end position
for each peptide is the start position plus nine

| 26 | SVPGMDLLSG | 18 |
| --- | --- | --- |
| 7 | WVLIQIFQVL | 17 |
| 8 | VLIQIFQVLC | 17 |
| 14 | QVLCGLIQQT | 17 |
| 15 | VLCGLIQQTV | 16 |
| 18 | GLIQQTVTSV | 16 |
| 19 | LIQQTVTSVP | 15 |
| 23 | TVTSVPGMDL | 14 |
| 9 | LIQIFQVLCG | 12 |
| 28 | PGMDLLSGTY | 12 |
| 11 | QIFQVLCGLI | 11 |
| 17 | CGLIQQTVTS | 11 |
| 2 | RTERQWVLIQ | 10 |

TABLE XXXVIII

109P1D4v.2
N' terminal-A26-10-mers
Each peptide is a portion of SEQ ID NO: 5;
each start position is specified, the length
of peptide is 10 amino acids, and the end position
for each peptide is the start position plus nine

| 4 | ERQWVLIQIF | 22 |
| --- | --- | --- |
| 23 | TVTSVPGMDL | 22 |
| 7 | WVLIQIFQVL | 18 |
| 26 | SVPGMDLLSG | 17 |
| 10 | IQIFQVLCGL | 16 |
| 24 | VTSVPGMDLL | 16 |
| 14 | QVLCGLIQQT | 15 |
| 22 | QTVTSVPGMD | 14 |

TABLE XXXVIII-continued

109P1D4v.2
N' terminal-A26-10-mers
Each peptide is a portion of SEQ ID NO: 5;
each start position is specified, the length
of peptide is 10 amino acids, and the end position
for each peptide is the start position plus nine

| 2 | RTERQWVLIQ | 13 |
| --- | --- | --- |
| 28 | PGMDLLSGTY | 13 |

TABLE XL

109P1D4v.2 N' terminal-B08-10mers

No Results Found.

TABLE XLI

109P1D4v.2 N' terminal-B1510-10mer

No Results Found.

TABLE XLII

109P1D4v.2 N' terminal-B2705-10mer

No Results Found.

TABLE XLIII

109P1D4v.2 N' terminal-B2709-10mer

No Results Found.

TABLE XLIV

109P1D4v.2
N' terminalB4402-10-mer
Each peptide is a portion of SEQ ID NO: 5;
each start position is specified, the length
of peptide is 10 amino acids, and the end position
for each peptide is the start position plus nine

| 3 | TERQWVLIQI | 21 |
| --- | --- | --- |
| 4 | ERQWVLIQIF | 15 |
| 10 | IQIFQVLCGL | 14 |
| 7 | WVLIQIFQVL | 13 |
| 28 | PGMDLLSGTY | 13 |
| 24 | VTSVPGMDLL | 12 |
| 11 | QIFQVLCGLI | 11 |

TABLE XLV

109P1D4v.2 N' terminal-B5101-10mer

No Results Found.

TABLE XLVI

109P1D4v.2
N' terminal-DRB1 0101 15-mers
Each peptide is a portion of SEQ ID NO: 5; each start position is specified, the length of peptide is 15 amino acids, and the end position for each peptide is the start position plus fourteen

| | | |
|---|---|---|
| 27 | VPGMDLLSGTYIFAV | 34 |
| 21 | QQTVTSVPGMDLLSG | 31 |
| 4 | ERQWVLIQIFQVLCG | 26 |
| 10 | IQIFQVLCGLIQQTV | 26 |
| 5 | RQWVLIQIFQVLCGL | 25 |
| 13 | FQVLCGLIQQTVTSV | 24 |
| 15 | VLCGLIQQTVTSVPG | 23 |
| 16 | LCGLIQQTVTSVPGM | 23 |
| 9 | LIQIFQVLCGLIQQT | 22 |
| 17 | CGLIQQTVTSVPGMD | 22 |
| 8 | VLIQIFQVLCGLIQQ | 17 |

TABLE XLVII

109P1D4v.2
N' terminal-DRB1 0301-15-mers
Each peptide is a portion of SEQ ID NO: 5; each start position is specified, the length of peptide is 15 amino acids, and the end position for each peptide is the start position plus fourteen

| | | |
|---|---|---|
| 5 | RQWVLIQIFQVLCGL | 21 |
| 21 | QQTVTSVPGMDLLSG | 21 |
| 6 | QWVLIQIFQVLCGLI | 19 |
| 13 | FQVLCGLIQQTVTSV | 17 |
| 12 | IFQVLCGLIQQTVTS | 14 |
| 29 | GMDLLSGTYIFAVLL | 13 |
| 9 | LIQIFQVLCGLIQQT | 12 |
| 25 | TSVPGMDLLSGTYIF | 12 |
| 27 | VPGMDLLSGTYIFAV | 12 |
| 28 | PGMDLLSGTYIFAVL | 12 |
| 7 | WVLIQIFQVLCGLIQ | 11 |
| 16 | LCGLIQQTVTSVPGM | 11 |
| 24 | VTSVPGMDLLSGTYI | 11 |

TABLE XLVIII

109P1D4v.2
N' terminal-DRB1 0401-15-mers
Each peptide is a portion of SEQ ID NO: 5; each start position is specified, the length of peptide is 15 amino acids, and the end position for each peptide is the start position plus fourteen

| | | |
|---|---|---|
| 13 | FQVLCGLIQQTVTSV | 26 |
| 4 | ERQWVLIQIFQVLCG | 22 |

TABLE XLVIII-continued

109P1D4v.2
N' terminal-DRB1 0401-15-mers
Each peptide is a portion of SEQ ID NO: 5; each start position is specified, the length of peptide is 15 amino acids, and the end position for each peptide is the start position plus fourteen

| | | |
|---|---|---|
| 10 | IQIFQVLCGLIQQTV | 22 |
| 6 | QWVLIQIFQVLCGLI | 20 |
| 9 | LIQIFQVLCGLIQQT | 20 |
| 21 | QQTVTSVPGMDLLSG | 20 |
| 27 | VPGMDLLSGTYIFAV | 20 |
| 3 | TERQWVLIQIFQVLC | 18 |
| 14 | QVLCGLIQQTVTSVP | 18 |
| 5 | RQWVLIQIFQVLCGL | 14 |
| 7 | WVLIQIFQVLCGLIQ | 14 |
| 12 | IFQVLCGLIQQTVTS | 14 |
| 16 | LCGLIQQTVTSVPGM | 14 |
| 17 | CGLIQQTVTSVPGMD | 14 |
| 29 | GMDLLSGTYIFAVLL | 14 |

TABLE XLIX

109P1D4v.2
N' Terminal-DRB1 1101 15-mers
Each peptide is a portion of SEQ ID NO: 5; each start position is specified, the length of peptide is 15 amino acids, and the end position for each peptide is the start position plus fourteen

| | | |
|---|---|---|
| 10 | IQIFQVLCGLIQQTV | 18 |
| 24 | VTSVPGMDLLSGTYI | 18 |
| 4 | ERQWVLIQIFQVLCG | 16 |
| 17 | CGLIQQTVTSVPGMD | 15 |
| 9 | LIQIFQVLCGLIQQT | 14 |
| 21 | QQTVTSVPGMDLLSG | 14 |
| 6 | QWVLIQIFQVLCGLI | 13 |
| 7 | WVLIQIFQVLCGLIQ | 12 |
| 13 | FQVLCGLIQQTVTSV | 12 |
| 18 | GLIQQTVTSVPGMDL | 12 |
| 27 | VPGMDLLSGTYIFAV | 12 |
| 29 | GMDLLSGTYIFAVLL | 12 |

TABLE XXII

109P1D4 v.3-A1-9-mers
Each peptide is a portion of SEQ ID NO: 7;
each start position is specified, the length
of peptide is 9 amino acids, and the end position
for each peptide is the start position plus eight

| | | |
|---|---|---|
| 78 | TSHGLPLGY | 26 |
| 234 | SAQASALCY | 23 |
| 135 | NCTQECLIY | 21 |
| 62 | SSDGGLGDH | 19 |
| 69 | DHDAGSLTS | 18 |
| 100 | RTEGDGNSD | 18 |
| 106 | NSDPESTFI | 18 |
| 111 | STFIPGLKK | 18 |
| 83 | PLGYPQEEY | 17 |
| 108 | DPESTFIPG | 17 |
| 37 | KSEGKVAGK | 16 |
| 61 | SSSDGGLGD | 15 |
| 132 | ASDNCTQEC | 15 |
| 288 | SVDQGVQGS | 15 |
| 294 | QGSATSQFY | 15 |
| 302 | YTMSERLHP | 15 |
| 310 | PSDDSIKVI | 15 |
| 87 | PQEEYFDRA | 14 |
| 145 | HSDACWMPA | 14 |
| 304 | MSERLHPSD | 14 |
| 10 | MKEVVRSCT | 13 |
| 154 | SLDHSSSSQ | 13 |
| 186 | VTQTIALCH | 13 |
| 198 | VTQTIALCH | 13 |
| 256 | SPLPQVIAL | 13 |

TABLE XXIII

109P1D4 v.3-A0201-9-mers
Each peptide is a portion of SEQ ID NO: 7;
each start position is specified, the length
of peptide is 9 amino acids, and the end position
for each peptide is the start position plus eight

| | | |
|---|---|---|
| 74 | SLTSTSHGL | 23 |
| 215 | ALHHSPPLV | 23 |
| 285 | GLCSVDQGV | 22 |
| 307 | RLHPSDDSI | 22 |
| 203 | ALCHSPPPI | 21 |
| 256 | SPLPQVIAL | 21 |
| 281 | QGADGLCSV | 21 |

TABLE XXIII-continued

109P1D4 v.3-A0201-9-mers
Each peptide is a portion of SEQ ID NO: 7;
each start position is specified, the length
of peptide is 9 amino acids, and the end position
for each peptide is the start position plus eight

| | | |
|---|---|---|
| 238 | SALCYSPPL | 20 |
| 166 | SALCHSPPL | 19 |
| 190 | IALCHSPPV | 19 |
| 214 | SALHHSPPL | 19 |
| 227 | ALHHSPPSA | 19 |
| 5 | HTRPPMKEV | 18 |
| 250 | AAISHSSPL | 18 |
| 253 | SHSSPLPQV | 18 |
| 267 | SQAQSSVSL | 18 |
| 121 | AEITVQPTV | 17 |
| 140 | CLIYGHSDA | 17 |
| 147 | DACWMPASL | 17 |
| 178 | STQHHSPRV | 17 |
| 191 | ALCHSPPVT | 17 |
| 53 | HLPEGSQES | 16 |
| 113 | FIPGLKKAA | 16 |
| 124 | TVQPTVEEA | 16 |
| 239 | ALCYSPPLA | 16 |
| 272 | SVSLQQGWV | 16 |
| 274 | SLQQGWVQG | 16 |
| 314 | SIKVIPLTT | 16 |
| 316 | KVIPLTTFT | 16 |
| 42 | VAGKSQRRV | 15 |
| 66 | GLGDHDAGS | 15 |
| 112 | TFIPGLKKA | 15 |
| 261 | VIALHRSQA | 15 |
| 303 | TMSERLHPS | 15 |
| 46 | SQRRVTFHL | 14 |
| 67 | LGDHDAGSL | 14 |
| 70 | HDAGSLTST | 14 |
| 81 | GLPLGYPQE | 14 |
| 109 | PESTFIPGL | 14 |
| 116 | GLKKAAEIT | 14 |
| 141 | LIYGHSDAC | 14 |
| 154 | SLDHSSSSQ | 14 |
| 194 | HSPPVTQTI | 14 |
| 263 | ALHRSQAQS | 14 |

TABLE XXIII-continued

109P1D4 v.3-A0201-9-mers
Each peptide is a portion of SEQ ID NO: 7;
each start position is specified, the length
of peptide is 9 amino acids, and the end position
for each peptide is the start position plus eight

| 278 | GWVQGADGL | 14 |
|---|---|---|
| 312 | DDSIKVIPL | 14 |
| 77 | STSHGLPLG | 13 |
| 117 | LKKAAEITV | 13 |
| 119 | KAAEITVQP | 13 |
| 120 | AAEITVQPT | 13 |
| 123 | ITVQPTVEE | 13 |
| 133 | SDNCTQECL | 13 |
| 160 | SSQAQASAL | 13 |
| 167 | ALCHSPPLS | 13 |
| 205 | CHSPPPIQV | 13 |
| 217 | HHSPPLVQA | 13 |
| 241 | CYSPPLAQA | 13 |
| 257 | PLPQVIALH | 13 |
| 275 | LQQGWVQGA | 13 |
| 288 | SVDQGVQGS | 13 |
| 309 | HPSDDSIKV | 13 |
| 317 | VIPLTTFTP | 13 |

TABLE XXIV

109P1D4v.3-A0203-9-mers

No Results Found.

TABLE XXV

109P1D4 v.3-A3-9-mers
Each peptide is a portion of SEQ ID NO: 7;
each start position is specified, the length
of peptide is 9 amino acids, and the end position
for each peptide is the start position plus eight

| 3 | SVHTRPPMK | 25 |
|---|---|---|
| 13 | VVRSCTPMK | 24 |
| 29 | WIHPQPQRK | 22 |
| 222 | LVQATALHH | 22 |
| 263 | ALHRSQAQS | 22 |
| 41 | KVAGKSQRR | 21 |
| 274 | SLQQGWVQG | 20 |
| 316 | KVIPLTTFT | 20 |
| 37 | KSEGKVAGK | 19 |

TABLE XXV-continued

109P1D4 v.3-A3-9-mers
Each peptide is a portion of SEQ ID NO: 7;
each start position is specified, the length
of peptide is 9 amino acids, and the end position
for each peptide is the start position plus eight

| 260 | QVIALHRSQ | 19 |
|---|---|---|
| 307 | RLHPSDDSI | 19 |
| 111 | STFIPGLKK | 18 |
| 140 | CLIYGHSDA | 18 |
| 173 | PLSQASTQH | 18 |
| 191 | ALCHSPPVT | 18 |
| 210 | PIQVSALHH | 18 |
| 257 | PLPQVIALH | 18 |
| 292 | GVQGSATSQ | 18 |
| 314 | SIKVIPLTT | 18 |
| 7 | RPPMKEVVR | 17 |
| 185 | RVTQTIALC | 17 |
| 221 | PLVQATALH | 17 |
| 245 | PLAQAAAIS | 17 |
| 261 | VIALHRSQA | 17 |
| 33 | QPQRKSEGK | 16 |
| 81 | GLPLGYPQE | 16 |
| 83 | PLGYPQEEY | 16 |
| 154 | SLDHSSSSQ | 16 |
| 212 | QVSALHHSP | 16 |
| 227 | ALHHSPPSA | 16 |
| 44 | GKSQRRVTF | 15 |
| 141 | LIYGHSDAC | 15 |
| 234 | SAQASALCY | 15 |
| 12 | EVVRSCTPM | 14 |
| 40 | GKVAGKSQR | 14 |
| 49 | RVTFHLPEG | 14 |
| 52 | FHLPEGSQE | 14 |
| 66 | GLGDHDAGS | 14 |
| 116 | GLKKAAEIT | 14 |
| 122 | EITVQPTVE | 14 |
| 162 | QAQASALCH | 14 |
| 167 | ALCHSPPLS | 14 |
| 203 | ALCHSPPPI | 14 |
| 215 | ALHHSPPLV | 14 |
| 239 | ALCYSPPLA | 14 |
| 272 | SVSLQQGWV | 14 |

TABLE XXV-continued

109P1D4 v.3-A3-9-mers
Each peptide is a portion of SEQ ID NO: 7;
each start position is specified, the length
of peptide is 9 amino acids, and the end position
for each peptide is the start position plus eight

| | | |
|---|---|---|
| 45 | KSQRRVTFH | 13 |
| 53 | HLPEGSQES | 13 |
| 92 | FDRATPSNR | 13 |
| 124 | TVQPTVEEA | 13 |
| 189 | TIALCHSPP | 13 |
| 197 | PVTQTIALC | 13 |
| 201 | TIALCHSPP | 13 |
| 266 | RSQAQSSVS | 13 |
| 279 | WVQGADGLC | 13 |
| 288 | SVDQGVQGS | 13 |
| 308 | LHPSDDSIK | 13 |
| 317 | VIPLTTFTP | 13 |

TABLE XXVI

109P1D4 v.3-A26-9-mers
Each peptide is a portion of SEQ ID NO: 7;
each start position is specified, the length
of peptide is 9 amino acids, and the end position
for each peptide is the start position plus eight

| | | |
|---|---|---|
| 12 | EVVRSCTPM | 24 |
| 312 | DDSIKVIPL | 22 |
| 147 | DACWMPASL | 17 |
| 315 | IKVIPLTTF | 17 |
| 111 | STFIPGLKK | 16 |
| 124 | TVQPTVEEA | 16 |
| 256 | SPLPQVIAL | 16 |
| 260 | QVIALHRSQ | 16 |
| 313 | DSIKVIPLT | 16 |
| 316 | KVIPLTTFT | 16 |
| 335 | DSPMEEHPL | 16 |
| 49 | RVTFHLPEG | 15 |
| 90 | EYFDRATPS | 15 |
| 122 | EITVQPTVE | 15 |
| 127 | PTVEEASDN | 15 |
| 136 | CTQECLIYG | 15 |
| 185 | RVTQTIALC | 15 |
| 197 | PVTQTIALC | 15 |
| 288 | SVDQGVQGS | 15 |
| 23 | STTMEIWIH | 14 |

TABLE XXVI-continued

109P1D4 v.3-A26-9-mers
Each peptide is a portion of SEQ ID NO: 7;
each start position is specified, the length
of peptide is 9 amino acids, and the end position
for each peptide is the start position plus eight

| | | |
|---|---|---|
| 24 | TTMEIWIHP | 14 |
| 27 | EIWIHPQPQ | 14 |
| 110 | ESTFIPGLK | 14 |
| 184 | PRVTQTIAL | 14 |
| 188 | QTIALCHSP | 14 |
| 196 | PPVTQTIAL | 14 |
| 200 | QTIALCHSP | 14 |
| 208 | PPPIQVSAL | 14 |
| 250 | AAISHSSPL | 14 |
| 321 | TTFTPRQQA | 14 |
| 50 | VTFHLPEGS | 13 |
| 60 | ESSSDGGLG | 13 |
| 76 | TSTSHGLPL | 13 |
| 77 | STSHGLPLG | 13 |
| 78 | TSHGLPLGY | 13 |
| 128 | TVEEASDNC | 13 |
| 131 | EASDNCTQE | 13 |
| 284 | DGLCSVDQG | 13 |
| 3 | SVHTRPPMK | 12 |
| 13 | VVRSCTPMK | 12 |
| 22 | ESTTMEIWI | 12 |
| 39 | EGKVAGKSQ | 12 |
| 56 | EGSQESSSD | 12 |
| 71 | DAGSLTSTS | 12 |
| 109 | PESTFIPGL | 12 |
| 123 | ITVQPTVEE | 12 |
| 130 | EEASDNCTQ | 12 |
| 135 | NCTQECLIY | 12 |
| 139 | ECLIYGHSD | 12 |
| 212 | QVSALHHSP | 12 |
| 234 | SAQASALCY | 12 |
| 272 | SVSLQQGWV | 12 |
| 278 | GWVQGADGL | 12 |

TABLE XXVII

109P1D4 v.3-B0702-9-mers
Each peptide is a portion of SEQ ID NO: 7;
each start position is specified, the length
of peptide is 9 amino acids, and the end position
for each peptide is the start position plus eight

| | | |
|---|---|---|
| 232 | PPSAQASAL | 24 |
| 256 | SPLPQVIAL | 23 |
| 196 | PPVTQTIAL | 22 |
| 208 | PPPIQVSAL | 22 |
| 220 | PPLVQATAL | 22 |
| 330 | RPSRGDSPM | 20 |
| 18 | TPMKESTTM | 19 |
| 183 | SPRVTQTIA | 19 |
| 207 | SPPPIQVSA | 19 |
| 244 | PPLAQAAAI | 19 |
| 243 | SPPLAQAAA | 18 |
| 309 | HPSDDSIKV | 18 |
| 171 | SPPLSQAST | 17 |
| 195 | SPPVTQTIA | 17 |
| 219 | SPPLVQATA | 17 |
| 231 | SPPSAQASA | 17 |
| 8 | PPMKEVVRS | 15 |
| 7 | RPPMKEVVR | 14 |
| 76 | TSTSHGLPL | 14 |
| 114 | IPGLKKAAE | 14 |
| 193 | CHSPPVTQT | 14 |
| 217 | HHSPPLVQA | 14 |
| 312 | DDSIKVIPL | 14 |
| 318 | IPLTTFTPR | 14 |
| 46 | SQRRVTFHL | 13 |
| 96 | TPSNRTEGD | 13 |
| 109 | PESTFIPGL | 13 |
| 229 | HHSPPSAQA | 13 |
| 241 | CYSPPLAQA | 13 |
| 250 | AAISHSSPL | 13 |
| 267 | SQAQSSVSL | 13 |
| 324 | TPRQQARPS | 13 |
| 5 | HTRPPMKEV | 12 |
| 31 | HPQPQRKSE | 12 |
| 54 | LPEGSQESS | 12 |
| 59 | QESSSDGGL | 12 |
| 82 | LPLGYPQEE | 12 |

TABLE XXVII-continued

109P1D4 v.3-B0702-9-mers
Each peptide is a portion of SEQ ID NO: 7;
each start position is specified, the length
of peptide is 9 amino acids, and the end position
for each peptide is the start position plus eight

| | | |
|---|---|---|
| 108 | DPESTFIPG | 12 |
| 160 | SSQAQASAL | 12 |
| 166 | SALCHSPPL | 12 |
| 169 | CHSPPLSQA | 12 |
| 184 | PRVTQTIAL | 12 |
| 205 | CHSPPPIQV | 12 |
| 214 | SALHHSPPL | 12 |
| 238 | SALCYSPPL | 12 |
| 253 | SHSSPLPQV | 12 |
| 258 | LPQVIALHR | 12 |

TABLE XXVIII

109P1D4 v.3-B08-9-mers
Each peptide is a portion of SEQ ID NO: 7;
each start position is specified, the length
of peptide is 9 amino acids, and the end position
for each peptide is the start position plus eight

| | | |
|---|---|---|
| 312 | DDSIKVIPL | 21 |
| 256 | SPLPQVIAL | 20 |
| 114 | IPGLKKAAE | 19 |
| 46 | SQRRVTFHL | 18 |
| 74 | SLTSTSHGL | 18 |
| 208 | PPPIQVSAL | 18 |
| 220 | PPLVQATAL | 18 |
| 7 | RPPMKEVVR | 17 |
| 115 | PGLKKAAEI | 17 |
| 116 | GLKKAAEIT | 17 |
| 196 | PPVTQTIAL | 17 |
| 232 | PPSAQASAL | 17 |
| 314 | SIKVIPLTT | 17 |
| 33 | QPQRKSEGK | 16 |
| 44 | GKSQRRVTF | 16 |
| 166 | SALCHSPPL | 16 |
| 214 | SALHHSPPL | 16 |
| 238 | SALCYSPPL | 16 |
| 183 | SPRVTQTIA | 15 |
| 39 | EGKVAGKSQ | 14 |
| 96 | TPSNRTEGD | 14 |
| 147 | DACWMPASL | 14 |

TABLE XXVIII-continued

109P1D4 v.3-B08-9-mers
Each peptide is a portion of SEQ ID NO: 7;
each start position is specified, the length
of peptide is 9 amino acids, and the end position
for each peptide is the start position plus eight

| | | |
|---|---|---|
| 250 | AAISHSSPL | 14 |
| 262 | IALHRSQAQ | 14 |
| 9 | PMKEVVRSC | 13 |
| 160 | SSQAQASAL | 13 |
| 244 | PPLAQAAAI | 13 |
| 267 | SQAQSSVSL | 13 |
| 19 | PMKESTTME | 12 |
| 133 | SDNCTQECL | 12 |
| 203 | ALCHSPPPI | 12 |
| 307 | RLHPSDDSI | 12 |
| 324 | TPRQQARPS | 12 |
| 35 | QRKSEGKVA | 11 |
| 37 | KSEGKVAGK | 11 |
| 109 | PESTFIPGL | 11 |
| 184 | PRVTQTIAL | 11 |
| 278 | GWVQGADGL | 11 |

TABLE XXIX

109P1D4 v.3-B1510-9-mers
Each peptide is a portion of SEQ ID NO: 7;
each start position is specified, the length
of peptide is 9 amino acids, and the end position
for each peptide is the start position plus eight

| | | |
|---|---|---|
| 30 | IHPQPQRKS | 16 |
| 217 | HHSPPLVQA | 16 |
| 180 | QHHSPRVTQ | 15 |
| 193 | CHSPPVTQT | 15 |
| 205 | CHSPPPIQV | 15 |
| 169 | CHSPPLSQA | 14 |
| 181 | HHSPRVTQT | 14 |
| 216 | LHHSPPLVQ | 14 |
| 229 | HHSPPSAQA | 14 |
| 256 | SPLPQVIAL | 14 |
| 267 | SQAQSSVSL | 14 |
| 44 | GKSQRRVTF | 13 |
| 109 | PESTFIPGL | 13 |
| 144 | GHSDACWMP | 13 |
| 228 | LHHSPPSAQ | 13 |

TABLE XXIX-continued

109P1D4 v.3-B1510-9-mers
Each peptide is a portion of SEQ ID NO: 7;
each start position is specified, the length
of peptide is 9 amino acids, and the end position
for each peptide is the start position plus eight

| | | |
|---|---|---|
| 253 | SHSSPLPQV | 13 |
| 278 | GWVQGADGL | 13 |
| 4 | VHTRPPMKE | 12 |
| 52 | FHLPEGSQE | 12 |
| 69 | DHDAGSLTS | 12 |
| 156 | DHSSSSQAQ | 12 |
| 208 | PPPIQVSAL | 12 |
| 220 | PPLVQATAL | 12 |
| 232 | PPSAQASAL | 12 |
| 300 | QFYTMSERL | 12 |
| 312 | DDSIKVIPL | 12 |
| 59 | QESSSDGGL | 11 |
| 76 | TSTSHGLPL | 11 |
| 79 | SHGLPLGYP | 11 |
| 105 | GNSDPESTF | 11 |
| 147 | DACWMPASL | 11 |
| 160 | SSQAQASAL | 11 |
| 166 | SALCHSPPL | 11 |
| 184 | PRVTQTIAL | 11 |
| 196 | PPVTQTIAL | 11 |
| 214 | SALHHSPPL | 11 |
| 238 | SALCYSPPL | 11 |
| 46 | SQRRVTFHL | 10 |
| 67 | LGDHDAGSL | 10 |
| 74 | SLTSTSHGL | 10 |
| 133 | SDNCTQECL | 10 |
| 250 | AAISHSSPL | 10 |
| 264 | LHRSQAQSS | 10 |
| 308 | LHPSDDSIK | 10 |
| 315 | IKVIPLTTF | 10 |
| 335 | DSPMEEHPL | 10 |
| 18 | TPMKESTTM | 9 |
| 2 | VSVHTRPPM | 8 |
| 84 | LGYPQEEYF | 8 |
| 330 | RPSRGDSPM | 8 |

TABLE XXX

109P1D4 v.3-B2705-9-mers
Each peptide is a portion of SEQ ID NO: 7;
each start position is specified, the length
of peptide is 9 amino acids, and the end position
for each peptide is the start position plus eight

| Start | Peptide | Score |
|---|---|---|
| 325 | PRQQARPSR | 24 |
| 184 | PRVTQTIAL | 22 |
| 40 | GKVAGKSQR | 19 |
| 278 | GWVQGADGL | 19 |
| 28 | IWIHPQPQR | 18 |
| 41 | KVAGKSQRR | 18 |
| 7 | RPPMKEVVR | 17 |
| 37 | KSEGKVAGK | 17 |
| 44 | GKSQRRVTF | 17 |
| 111 | STFIPGLKK | 17 |
| 315 | IKVIPLTTF | 17 |
| 48 | RRVTFHLPE | 16 |
| 99 | NRTEGDGNS | 16 |
| 105 | GNSDPESTF | 16 |
| 265 | HRSQAQSSV | 16 |
| 267 | SQAQSSVSL | 16 |
| 330 | RPSRGDSPM | 16 |
| 18 | TPMKESTTM | 15 |
| 93 | DRATPSNRT | 15 |
| 209 | PPIQVSALH | 15 |
| 220 | PPLVQATAL | 15 |
| 250 | AAISHSSPL | 15 |
| 256 | SPLPQVIAL | 15 |
| 257 | PLPQVIALH | 15 |
| 299 | SQFYTMSER | 15 |
| 300 | QFYTMSERL | 15 |
| 318 | IPLTTFTPR | 15 |
| 72 | AGSLTSTSH | 14 |
| 109 | PESTFIPGL | 14 |
| 115 | PGLKKAAEI | 14 |
| 166 | SALCHSPPL | 14 |
| 173 | PLSQASTQH | 14 |
| 177 | ASTQHHSPR | 14 |
| 214 | SALHHSPPL | 14 |
| 238 | SALCYSPPL | 14 |
| 306 | ERLHPSDDS | 14 |
| 307 | RLHPSDDSI | 14 |
| 333 | RGDSPMEEH | 14 |
| 6 | TRPPMKEVV | 13 |
| 14 | VRSCTPMKE | 13 |
| 23 | STTMEIWIH | 13 |
| 29 | WIHPQPQRK | 13 |
| 45 | KSQRRVTFH | 13 |
| 62 | SSDGGLGDH | 13 |
| 84 | LGYPQEEYF | 13 |
| 92 | FDRATPSNR | 13 |
| 137 | TQECLIYGH | 13 |
| 258 | LPQVIALHR | 13 |
| 312 | DDSIKVIPL | 13 |
| 322 | TFTPRQQAR | 13 |
| 332 | SRGDSPMEE | 13 |
| 12 | EVVRSCTPM | 12 |
| 33 | QPQRKSEGK | 12 |
| 35 | QRKSEGKVA | 12 |
| 59 | QESSSDGGL | 12 |
| 67 | LGDHDAGSL | 12 |
| 78 | TSHGLPLGY | 12 |
| 83 | PLGYPQEEY | 12 |
| 86 | YPQEEYFDR | 12 |
| 133 | SDNCTQECL | 12 |
| 135 | NCTQECLIY | 12 |
| 147 | DACWMPASL | 12 |
| 160 | SSQAQASAL | 12 |
| 196 | PPVTQTIAL | 12 |
| 208 | PPPIQVSAL | 12 |
| 221 | PLVQATALH | 12 |
| 232 | PPSAQASAL | 12 |
| 293 | VQGSATSQF | 12 |
| 308 | LHPSDDSIK | 12 |
| 329 | ARPSRGDSP | 12 |

TABLE XXXI

109P1D4 v.3-B2709-9-mers
Each peptide is a portion of SEQ ID NO: 7;
each start position is specified, the length
of peptide is 9 amino acids, and the end position
for each peptide is the start position plus eight

| | | |
|---|---|---|
| 184 | PRVTQTIAL | 21 |
| 6 | TRPPMKEVV | 19 |
| 265 | HRSQAQSSV | 18 |
| 48 | RRVTFHLPE | 16 |
| 278 | GWVQGADGL | 15 |
| 256 | SPLPQVIAL | 14 |
| 76 | TSTSHGLPL | 13 |
| 166 | SALCHSPPL | 13 |
| 214 | SALHHSPPL | 13 |
| 220 | PPLVQATAL | 13 |
| 238 | SALCYSPPL | 13 |
| 250 | AAISHSSPL | 13 |
| 300 | QFYTMSERL | 13 |
| 307 | RLHPSDDSI | 13 |
| 44 | GKSQRRVTF | 12 |
| 67 | LGDHDAGSL | 12 |
| 74 | SLTSTSHGL | 12 |
| 99 | NRTEGDGNS | 12 |
| 190 | IALCHSPPV | 12 |
| 285 | GLCSVDQGV | 12 |
| 306 | ERLHPSDDS | 12 |
| 329 | ARPSRGDSP | 12 |
| 330 | RPSRGDSPM | 12 |
| 35 | QRKSEGKVA | 11 |
| 59 | QESSSDGGL | 11 |
| 84 | LGYPQEEYF | 11 |
| 93 | DRATPSNRT | 11 |
| 105 | GNSDPESTF | 11 |
| 109 | PESTFIPGL | 11 |
| 115 | PGLKKAAEI | 11 |
| 121 | AEITVQPTV | 11 |
| 143 | YGHSDACWM | 11 |
| 160 | SSQAQASAL | 11 |
| 196 | PPVTQTIAL | 11 |
| 208 | PPPIQVSAL | 11 |
| 232 | PPSAQASAL | 11 |
| 244 | PPLAQAAAI | 11 |

TABLE XXXI-continued

109P1D4 v.3-B2709-9-mers
Each peptide is a portion of SEQ ID NO: 7;
each start position is specified, the length
of peptide is 9 amino acids, and the end position
for each peptide is the start position plus eight

| | | |
|---|---|---|
| 253 | SHSSPLPQV | 11 |
| 267 | SQAQSSVSL | 11 |
| 296 | SATSQFYTM | 11 |
| 312 | DDSIKVIPL | 11 |
| 325 | PRQQARPSR | 11 |

TABLE XXXII

109P1D4v.3-B4402-9-mers
Each peptide is a portion of SEQ ID NO: 7;
each start position is specified, the length
of peptide is 9 amino acids, and the end position
for each peptide is the start position plus eight

| | | |
|---|---|---|
| 109 | PESTFIPGL | 25 |
| 21 | KESTTMEIW | 23 |
| 59 | QESSSDGGL | 21 |
| 256 | SPLPQVIAL | 19 |
| 121 | AEITVQPTV | 18 |
| 250 | AAISHSSPL | 16 |
| 310 | PSDDSIKVI | 16 |
| 26 | MEIWIHPQP | 15 |
| 44 | GKSQRRVTF | 15 |
| 184 | PRVTQTIAL | 15 |
| 196 | PPVTQTIAL | 15 |
| 89 | EEYFDRATP | 14 |
| 160 | SSQAQASAL | 14 |
| 194 | HSPPVTQTI | 14 |
| 208 | PPPIQVSAL | 14 |
| 220 | PPLVQATAL | 14 |
| 232 | PPSAQASAL | 14 |
| 254 | HSSPLPQVI | 14 |
| 11 | KEVVRSCTP | 13 |
| 38 | SEGKVAGKS | 13 |
| 46 | SQRRVTFHL | 13 |
| 78 | TSHGLPLGY | 13 |
| 84 | LGYPQEEYF | 13 |
| 88 | QEEYFDRAT | 13 |
| 105 | GNSDPESTF | 13 |
| 106 | NSDPESTFI | 13 |
| 130 | EEASDNCTQ | 13 |

TABLE XXXII-continued

109P1D4v.3-B4402-9-mers
Each peptide is a portion of SEQ ID NO: 7;
each start position is specified, the length
of peptide is 9 amino acids, and the end position
for each peptide is the start position plus eight

| Start | Peptide | Score |
|---|---|---|
| 234 | SAQASALCY | 13 |
| 305 | SERLHPSDD | 13 |
| 312 | DDSIKVIPL | 13 |

TABLE XXXIII

109P1D4v.3-B5101 9-mers
Each peptide is a portion of SEQ ID NO: 7;
each start position is specified, the length
of peptide is 9 amino acids, and the end position
for each peptide is the start position plus eight

| Start | Peptide | Score |
|---|---|---|
| 244 | PPLAQAAAI | 24 |
| 42 | VAGKSQRRV | 23 |
| 147 | DACWMPASL | 22 |
| 190 | IALCHSPPV | 22 |
| 309 | HPSDDSIKV | 22 |
| 115 | PGLKKAAEI | 21 |
| 256 | SPLPQVIAL | 21 |
| 220 | PPLVQATAL | 20 |
| 208 | PPPIQVSAL | 19 |
| 238 | SALCYSPPL | 19 |
| 166 | SALCHSPPL | 18 |
| 196 | PPVTQTIAL | 18 |
| 214 | SALHHSPPL | 18 |
| 232 | PPSAQASAL | 18 |
| 318 | IPLTTFTPR | 18 |
| 82 | LPLGYPQEE | 17 |
| 108 | DPESTFIPG | 17 |
| 310 | PSDDSIKVI | 17 |
| 7 | RPPMKEVVR | 16 |
| 71 | DAGSLTSTS | 16 |
| 250 | AAISHSSPL | 16 |
| 281 | QGADGLCSV | 16 |
| 8 | PPMKEVVRS | 15 |
| 18 | TPMKESTTM | 15 |
| 67 | LGDHDAGSL | 15 |
| 94 | RATPSNRTE | 15 |
| 134 | DNCTQECLI | 15 |
| 172 | PPLSQASTQ | 15 |
| 182 | HSPRVTQTI | 15 |
| 194 | HSPPVTQTI | 15 |

TABLE XXXIII-continued

109P1D4v.3-B5101 9-mers
Each peptide is a portion of SEQ ID NO: 7;
each start position is specified, the length
of peptide is 9 amino acids, and the end position
for each peptide is the start position plus eight

| Start | Peptide | Score |
|---|---|---|
| 219 | SPPLVQATA | 15 |
| 246 | LAQAAAISH | 15 |
| 258 | LPQVIALHR | 15 |
| 284 | DGLCSVDQG | 15 |
| 6 | TRPPMKEVV | 14 |
| 54 | LPEGSQESS | 14 |
| 86 | YPQEEYFDR | 14 |
| 117 | LKKAAEITV | 14 |
| 162 | QAQASALCH | 14 |
| 202 | IALCHSPPP | 14 |
| 234 | SAQASALCY | 14 |
| 254 | HSSPLPQVI | 14 |
| 262 | IALHRSQAQ | 14 |
| 282 | GADGLCSVD | 14 |
| 312 | DDSIKVIPL | 14 |
| 22 | ESTTMEIWI | 13 |
| 114 | IPGLKKAAE | 13 |
| 119 | KAAEITVQP | 13 |
| 120 | AAEITVQPT | 13 |
| 121 | AEITVQPTV | 13 |
| 195 | SPPVTQTIA | 13 |
| 226 | TALHHSPPS | 13 |
| 268 | QAQSSVSLQ | 13 |
| 296 | SATSQFYTM | 13 |
| 300 | QFYTMSERL | 13 |
| 324 | TPRQQARPS | 13 |
| 20 | MKESTTMEI | 12 |
| 34 | PQRKSEGKV | 12 |
| 84 | LGYPQEEYF | 12 |
| 106 | NSDPESTFI | 12 |
| 131 | EASDNCTQE | 12 |
| 171 | SPPLSQAST | 12 |
| 183 | SPRVTQTIA | 12 |
| 203 | ALCHSPPPI | 12 |
| 207 | SPPPIQVSA | 12 |
| 209 | PPIQVSALH | 12 |

TABLE XXXIV

109P1D4v.3-A1 10-mers
Each peptide is a portion of SEQ ID NO: 7;
each start position is specified, the length
of peptide is 10 amino acids, and the end position
for each peptide is the start position plus nine

| | | |
|---|---|---|
| 78 | STSHGLPLGY | 29 |
| 234 | PSAQASALCY | 25 |
| 135 | DNCTQECLIY | 21 |
| 63 | SSDGGLGDHD | 18 |
| 101 | RTEGDGNSDP | 18 |
| 107 | NSDPESTFIP | 18 |
| 38 | KSEGKVAGKS | 17 |
| 312 | SDDSIKVIPL | 17 |
| 83 | LPLGYPQEEY | 16 |
| 294 | VQGSATSQFY | 16 |
| 133 | ASDNCTQECL | 15 |

TABLE XXXV

109P1D4 v.3-A0201-10-mers
Each peptide is a portion of SEQ ID NO: 7;
each start position is specified, the length
of peptide is 10 amino acids, and the end position
for each peptide is the start position plus nine

| | | |
|---|---|---|
| 67 | GLGDHDAGSL | 24 |
| 117 | GLKKAAEITV | 22 |
| 190 | TIALCHSPPV | 21 |
| 275 | SLQQGWVQGA | 21 |
| 42 | KVAGKSQRRV | 19 |
| 208 | SPPPIQVSAL | 19 |
| 215 | SALHHSPPLV | 19 |
| 121 | AAEITVQPTV | 18 |
| 147 | SDACWMPASL | 18 |
| 250 | AAAISHSSPL | 18 |
| 76 | LTSTSHGLPL | 17 |
| 120 | KAAEITVQPT | 17 |
| 203 | IALCHSPPPI | 17 |
| 253 | ISHSSPLPQV | 17 |
| 256 | SSPLPQVIAL | 17 |
| 281 | VQGADGLCSV | 17 |
| 6 | HTRPPMKEVV | 16 |
| 20 | PMKESTTMEI | 16 |
| 112 | STFIPGLKKA | 16 |
| 124 | ITVQPTVEEA | 16 |
| 155 | SLDHSSSQA | 16 |

TABLE XXXV-continued

109P1D4 v.3-A0201-10-mers
Each peptide is a portion of SEQ ID NO: 7;
each start position is specified, the length
of peptide is 10 amino acids, and the end position
for each peptide is the start position plus nine

| | | |
|---|---|---|
| 192 | ALCHSPPVTQ | 16 |
| 312 | SDDSIKVIPL | 16 |
| 74 | GSLTSTSHGL | 15 |
| 142 | LIYGHSDACW | 15 |
| 166 | ASALCHSPPL | 15 |
| 168 | ALCHSPPLSQ | 15 |
| 238 | ASALCYSPPL | 15 |
| 315 | SIKVIPLTTF | 15 |
| 54 | HLPEGSQESS | 14 |
| 109 | DPESTFIPGL | 14 |
| 114 | FIPGLKKAAE | 14 |
| 115 | IPGLKKAAEI | 14 |
| 214 | VSALHHSPPL | 14 |
| 264 | ALHRSQAQSS | 14 |
| 265 | LHRSQAQSSV | 14 |
| 267 | RSQAQSSVSL | 14 |
| 309 | LHPSDDSIKV | 14 |
| 335 | GDSPMEEHPL | 14 |
| 82 | GLPLGYPQEE | 13 |
| 160 | SSSQAQASAL | 13 |
| 184 | SPRVTQTIAL | 13 |
| 191 | IALCHSPPVT | 13 |
| 196 | SPPVTQTIAL | 13 |
| 204 | ALCHSPPPIQ | 13 |
| 216 | ALHHSPPLVQ | 13 |
| 220 | SPPLVQATAL | 13 |
| 227 | TALHHSPPSA | 13 |
| 228 | ALHHSPPSAQ | 13 |
| 232 | SPPSAQASAL | 13 |
| 239 | SALCYSPPLA | 13 |
| 240 | ALCYSPPLAQ | 13 |
| 241 | LCYSPPLAQA | 13 |
| 244 | SPPLAQAAAI | 13 |
| 304 | TMSERLHPSD | 13 |
| 25 | TTMEIWIHPQ | 12 |
| 30 | WIHPQEQRKS | 12 |
| 34 | QPQRKSEGKV | 12 |

TABLE XXXV-continued

109P1D4 v.3-A0201-10-mers
Each peptide is a portion of SEQ ID NO: 7;
each start position is specified, the length
of peptide is 10 amino acids, and the end position
for each peptide is the start position plus nine

| | | |
|---|---|---|
| 59 | SQESSSDGGL | 12 |
| 133 | ASDNCTQECL | 12 |
| 137 | CTQECLIYGH | 12 |
| 141 | CLIYGHSDAC | 12 |
| 178 | ASTQHHSPRV | 12 |
| 182 | HHSPRVTQTI | 12 |
| 194 | CHSPPVTQTI | 12 |
| 205 | LCHSPPPIQV | 12 |
| 217 | LHHSPPLVQA | 12 |
| 257 | SPLPQVIALH | 12 |
| 262 | VIALHRSQAQ | 12 |
| 272 | SSVSLQQGWV | 12 |
| 278 | QGWVQGADGL | 12 |
| 285 | DGLCSVDQGV | 12 |
| 289 | SVDQGVQGSA | 12 |
| 300 | SQFYTMSERL | 12 |
| 303 | YTMSEELHPS | 12 |
| 308 | RLHPSDDSIK | 12 |
| 310 | HPSDDSIKVI | 12 |

TABLE XXXVI

109P1D4v.3-A0203-10-mers
Each peptide is a portion of SEQ ID NO: 7;
each start position is specified, the length
of peptide is 10 amino acids, and the end position
for each peptide is the start position plus nine

| | | |
|---|---|---|
| 243 | YSPPLAQAAA | 27 |
| 113 | TFIPGLKKAA | 19 |
| 242 | CYSPPLAQAA | 19 |
| 157 | DHSSSSQAQA | 18 |
| 159 | SSSSQAQASA | 18 |
| 219 | HSPPLVQATA | 18 |
| 229 | LHHSPPSAQA | 18 |
| 231 | HSPPSAQASA | 18 |
| 241 | LCYSPPLAQA | 18 |
| 114 | FIPGLKKAAE | 17 |
| 244 | SPPLAQAAAI | 17 |

TABLE XXXVII

109P1D4v.3-A3 10-mers
Each peptide is a portion of SEQ ID NO: 7;
each start position is specified, the length
of peptide is 10 amino acids, and the end position
for each peptide is the start position plus nine

| | | |
|---|---|---|
| 308 | RLHPSDDSIK | 30 |
| 13 | EVVRSCTPMK | 24 |
| 186 | RVTQTIALCH | 24 |
| 261 | QVIALHRSQA | 24 |
| 317 | KVIPLTTFTP | 23 |
| 192 | ALCHSPPVTQ | 22 |
| 293 | GVQGSATSQF | 22 |
| 216 | ALHHSPPLVQ | 21 |
| 264 | ALHRSQAQSS | 21 |
| 198 | PVTQTLALCH | 20 |
| 222 | PLVQATALHH | 20 |
| 246 | PLAQAAAISH | 20 |
| 258 | PLPQVIALHR | 20 |
| 168 | ALCHSPPLSQ | 19 |
| 273 | SVSLQQGWVQ | 19 |
| 315 | SIKVIPLTTF | 19 |
| 37 | RKSEGKVAGK | 18 |
| 228 | ALHHSPPSAQ | 18 |
| 240 | ALCYSPPLAQ | 18 |
| 280 | WVQGADGLCS | 18 |
| 44 | AGKSQRRVTF | 17 |
| 67 | GLGDHDAGSL | 17 |
| 142 | LIYGHSDACW | 17 |
| 155 | SLDHSSSSQA | 17 |
| 213 | QVSALHHSPP | 17 |
| 28 | EIWIHPQPQR | 16 |
| 29 | IWIHPQPQRK | 16 |
| 42 | KVAGKSQRRV | 16 |
| 111 | ESTFIPGLKK | 16 |
| 7 | TRPPMKEVVR | 15 |
| 14 | VVRSCTPMKE | 15 |
| 50 | RVTFHLPEGS | 15 |
| 117 | GLKKAAEITV | 15 |
| 252 | AISHSSPLPQ | 15 |
| 286 | GLCSVDQGVQ | 15 |

TABLE XXXVIII

109P1D4v.3-A26 10-mers
Each peptide is a portion of SEQ ID NO: 7;
each start position is specified, the length
of peptide is 10 amino acids, and the end position
for each peptide is the start position plus nine

| | | |
|---|---|---|
| 13 | EVVRSCTPMK | 25 |
| 109 | DPESTFIPGL | 21 |
| 78 | STSHGLPLGY | 20 |
| 293 | GVQGSATSQF | 20 |
| 105 | DGNSDPESTF | 19 |
| 135 | DNCTQECLIY | 19 |
| 76 | LTSTSHGLPL | 18 |
| 112 | STFIPGLKKA | 18 |
| 315 | SIKVIPLTTF | 18 |
| 91 | EYFDRATPSN | 16 |
| 124 | ITVQPTVEEA | 16 |
| 208 | SPPPIQVSAL | 16 |
| 261 | QVIALHRSQA | 16 |
| 317 | KVIPLTTFTP | 16 |
| 23 | ESTTMEIWIH | 15 |
| 25 | TTMEIWIHPQ | 15 |
| 28 | EIWIHPQPQR | 15 |
| 123 | EITVQPTVEE | 15 |
| 256 | SSPLPQVIAL | 15 |
| 312 | SDDSIKVIPL | 15 |
| 51 | VTFHLPEGSQ | 14 |
| 111 | ESTFIPGLKK | 14 |
| 128 | PTVEEASDNC | 14 |
| 137 | CTQECLIYGH | 14 |
| 223 | LVQATALHHS | 14 |
| 314 | DSIKVIPLTT | 14 |
| 322 | TTFTPRQQAR | 14 |
| 61 | ESSSDGGLGD | 13 |
| 70 | DHDAGSLTST | 13 |
| 125 | TVQPTVEEAS | 13 |
| 129 | TVEEASDNCT | 13 |
| 189 | QTIALCHSPP | 13 |
| 201 | QTIALCHSPP | 13 |
| 289 | SVDQGVQGSA | 13 |
| 300 | SQFYTMSERL | 13 |
| 303 | YTMSERLHPS | 13 |

TABLE XXXIX

109P1D4v.3-B0702 10-mers
Each peptide is a portion of SEQ ID NO: 7;
each start position is specified, the length
of peptide is 10 amino acids, and the end position
for each peptide is the start position plus nine

| | | |
|---|---|---|
| 184 | SPRVTQTIAL | 24 |
| 208 | SPPPIQVSAL | 23 |
| 196 | SPPVTQTIAL | 22 |
| 220 | SPPLVQATAL | 22 |
| 109 | DPESTFIPGL | 21 |
| 232 | SPPSAQASAL | 21 |
| 115 | IPGLKKAAEI | 19 |
| 310 | HPSDDSIKVI | 19 |
| 244 | SPPLAQAAAI | 18 |
| 87 | YPQEEYFDRA | 17 |
| 34 | QPQRKSEGKV | 16 |
| 76 | LTSTSHGLPL | 15 |
| 166 | ASALCHSPPL | 15 |
| 238 | ASALCYSPPL | 15 |
| 8 | RPPMKEVVRS | 14 |
| 19 | TPMKESTTME | 14 |
| 233 | PPSAQASALC | 14 |
| 250 | AAAISHSSPL | 14 |
| 267 | RSQAQSSVSL | 14 |
| 325 | TPRQQARPSR | 14 |
| 331 | RPSRGDSPME | 14 |
| 335 | GDSPMEEHPL | 14 |
| 9 | PPMKEVVRSC | 13 |
| 133 | ASDNCTQECL | 13 |
| 160 | SSSQAQASAL | 13 |
| 214 | VSALHHSPPL | 13 |
| 312 | SDDSIKVIPL | 13 |
| 319 | IPLTTFTPRQ | 13 |
| 1 | VPVSVHTRPP | 12 |
| 46 | KSQRRVTFHL | 12 |
| 55 | LPEGSQESSS | 12 |
| 83 | LPLGYPQEEY | 12 |
| 97 | TPSNRTEGDG | 12 |
| 147 | SDACWMPASL | 12 |
| 210 | PPIQVSALHH | 12 |
| 221 | PPLVQATALH | 12 |
| 245 | PPLAQAAAIS | 12 |

TABLE XXXIX-continued

109P1D4v.3-B0702 10-mers
Each peptide is a portion of SEQ ID NO: 7;
each start position is specified, the length
of peptide is 10 amino acids, and the end position
for each peptide is the start position plus nine

| | | |
|---|---|---|
| 256 | SSPLPQVIAL | 12 |
| 257 | SPLPQVIALH | 12 |

TABLE XL

109P1D4v.3-B08 10-mers

No Results Found.

TABLE XLI

109P1D4v.3-B1510 10-mers

No Results Found.

TABLE XLII

109P1D4v.3-B2705 10-mers

No Results Found.

TABLE XLIII

109P1D4v.3-B2709 10-mers

No Results Found.

TABLE XLIV

109P1D4 v.3-B4402-10-mers
Each peptide is a portion of SEQ ID NO: 7;
each start position is specified, the length
of peptide is 10 amino acids, and the end position
for each peptide is the start position plus nine

| | | |
|---|---|---|
| 22 | KESTTMEIWI | 22 |
| 122 | AEITVQPTVE | 19 |
| 208 | SPPPIQVSAL | 18 |
| 256 | SSPLPQVIAL | 17 |
| 44 | AGKSQRRVTF | 16 |
| 196 | SPPVTQTIAL | 16 |
| 220 | SPPLVQATAL | 16 |
| 310 | HPSDDSIKVI | 16 |
| 133 | ASDNCTQECL | 15 |
| 160 | SSSQAQASAL | 15 |
| 184 | SPRVTQTIAL | 15 |
| 232 | SPPSAQASAL | 15 |
| 335 | GDSPMEEHPL | 15 |

TABLE XLIV-continued

109P1D4 v.3-B4402-10-mers
Each peptide is a portion of SEQ ID NO: 7;
each start position is specified, the length
of peptide is 10 amino acids, and the end position
for each peptide is the start position plus nine

| | | |
|---|---|---|
| 27 | MEIWIHPQPQ | 14 |
| 78 | STSHGLPLGY | 14 |
| 110 | PESTFIPGLK | 14 |
| 166 | ASALCHSPPL | 14 |
| 182 | HHSPRVTQTI | 14 |
| 194 | CHSPPVTQTI | 14 |
| 238 | ASALCYSPPL | 14 |
| 244 | SPPLAQAAAI | 14 |
| 312 | SDDSIKVIPL | 14 |
| 39 | SEGKVAGKSQ | 13 |
| 46 | KSQRRVTFHL | 13 |
| 74 | GSLTSTSHGL | 13 |
| 76 | LTSTSHGLPL | 13 |
| 90 | EEYFDRATPS | 13 |
| 109 | DPESTFIPGL | 13 |
| 131 | EEASDNCTQE | 13 |
| 250 | AAAISHSSPL | 13 |
| 293 | GVQGSATSQF | 13 |
| 300 | SQFYTMSERL | 13 |
| 315 | SIKVIPLTTF | 13 |
| 60 | QESSSDGGLG | 12 |
| 67 | GLGDHDAGSL | 12 |
| 83 | LPLGYPQEEY | 12 |
| 89 | QEEYFDRATP | 12 |
| 135 | DNCTQECLIY | 12 |
| 139 | QECLIYGHSD | 12 |
| 147 | SDACWMPASL | 12 |
| 234 | PSAQASALCY | 12 |
| 254 | SHSSPLPQVI | 12 |
| 306 | SERLHPSDDS | 12 |
| 12 | KEVVRSCTPM | 11 |
| 59 | SQESSSDGGL | 11 |
| 102 | TEGDGNSDPE | 11 |
| 105 | DGNSDPESTF | 11 |
| 130 | VEEASDNCTQ | 11 |
| 142 | LIYGHSDACW | 11 |
| 214 | VSALHHSPPL | 11 |

TABLE XLIV-continued

109P1D4 v.3-B4402-10-mers
Each peptide is a portion of SEQ ID NO: 7;
each start position is specified, the length
of peptide is 10 amino acids, and the end position
for each peptide is the start position plus nine

| | | |
|---|---|---|
| 267 | RSQAQSSVSL | 11 |
| 271 | QSSVSLQQGW | 11 |
| 278 | QGWVQGADGL | 11 |
| 307 | ERLHPSDDSI | 11 |

TABLE XLV

109P1D4v.3-B5101-10-mers

No Results Found.

TABLE XLVI

109P1D4v.3-DRB1 0101-15-mers
Each peptide is a portion of SEQ ID NO: 7; each
start position is specified, the length of peptide
is 15 amino acids, and the end position for
each peptide is the start position plus fourteen

| | | |
|---|---|---|
| 320 | SIKVIPLTTFTPRQQ | 30 |
| 53 | QRRVTFHLPEGSQES | 26 |
| 146 | CLIYGHSDACWMPAS | 26 |
| 245 | ALCYSPPLAQAAAIS | 26 |
| 281 | LQQGWVQGADGLCSV | 25 |
| 33 | EIWIHPQPQRKSEGK | 24 |
| 70 | DGGLGDHDAGSLTST | 24 |
| 216 | PIQVSALHHSPPLVQ | 24 |
| 223 | HHSPPLVQATALHHS | 24 |
| 264 | LPQVIALHRSQAQSS | 24 |
| 267 | VIALHRSQAQSSVSL | 24 |
| 283 | QGWVQGADGLCSVDQ | 24 |
| 318 | DDSIKVIPLTTFTPR | 24 |
| 23 | CTPMKESTTMEIWIH | 23 |
| 193 | TQTIALCHSPPVTQT | 23 |
| 205 | TQTIALCHSPPPIQV | 23 |
| 276 | QSSVSLQQGWVQGAD | 23 |
| 327 | TTFTPRQQARPSRGD | 23 |
| 4 | FEVPVSVHTRPPMKE | 22 |
| 38 | PQPQRKSEGKVAGKS | 22 |
| 158 | PASLDHSSSSQAQAS | 22 |
| 248 | YSPPLAQAAAISHSS | 22 |
| 261 | SSPLPQVIALHRSQA | 22 |
| 296 | DQGVQGSATSQFYTM | 22 |

TABLE XLVI-continued

109P1D4v.3-DRB1 0101-15-mers
Each peptide is a portion of SEQ ID NO: 7; each
start position is specified, the length of peptide
is 15 amino acids, and the end position for
each peptide is the start position plus fourteen

| | | |
|---|---|---|
| 126 | AAEITVQPTVEEASD | 21 |
| 294 | SVDQGVQGSATSQFY | 21 |
| 305 | SQFYTMSERLHPSDD | 21 |
| 14 | PPMKEVVRSCTPMKE | 20 |
| 55 | RVTFHLPEGSQESSS | 20 |
| 270 | LHRSQAQSSVSLQQG | 20 |
| 29 | STTMEIWIHPQPQRK | 19 |
| 116 | ESTFIPGLKKAAEIT | 19 |
| 120 | IPGLKKAAEITVQPT | 19 |
| 326 | LTTFTPRQQARPSRG | 19 |
| 93 | PQEEYFDRATPSNRT | 18 |
| 153 | DACWMPASLDHSSSS | 18 |
| 278 | SVSLQQGWVQGADGL | 18 |
| 291 | GLCSVDQGVQGSATS | 18 |
| 332 | RQQARPSRGDSPMEE | 18 |
| 3 | TFEVPVSVHTRPPMK | 17 |
| 17 | KEVVRSCTPMKESTT | 17 |
| 21 | RSCTPMKESTTMEIW | 17 |
| 41 | QRKSEGKVAGKSQRR | 17 |
| 42 | RKSEGKVAGKSQRRV | 17 |
| 45 | EGKVAGKSQRRVTFH | 17 |
| 67 | SSSDGGLGDHDAGSL | 17 |
| 78 | AGSLTSTSHGLPLGY | 17 |
| 114 | DPESTFIPGLKKAAE | 17 |
| 118 | TFIPGLKKAAEITVQ | 17 |
| 189 | SPRVTQTIALCHSPP | 17 |
| 201 | SPPVTQTIALCHSPP | 17 |
| 225 | SPPLVQATALHHSPP | 17 |
| 228 | LVQATALHHSPPSAQ | 17 |
| 247 | CYSPPLAQAAAISHS | 17 |
| 253 | AQAAAISHSSPLPQV | 17 |
| 275 | AQSSVSLQQGWVQGA | 17 |
| 304 | TSQFYTMSERLHPSD | 17 |
| 309 | TMSERLHPSDDSIKV | 17 |
| 1 | VTTFEVPVSVHTRPP | 16 |
| 5 | EVPVSVHTRPPMKEV | 16 |
| 32 | MEIWIHPQPQRKSEG | 16 |

TABLE XLVI-continued

109P1D4v.3-DRB1 0101-15-mers
Each peptide is a portion of SEQ ID NO: 7; each start position is specified, the length of peptide is 15 amino acids, and the end position for each peptide is the start position plus fourteen

| | | |
|---|---|---|
| 50 | GKSQRRVTFHLPEGS | 16 |
| 57 | TFHLPEGSQESSSDG | 16 |
| 77 | DAGSLTSTSHGLPLG | 16 |
| 79 | GSLTSTSHGLPLGYP | 16 |
| 82 | TSTSHGLPLGYPQEE | 16 |
| 87 | GLPLGYPQEEYFDRA | 16 |
| 94 | QEEYFDRATPSNRTE | 16 |
| 95 | EEYFDRATPSNRTEG | 16 |
| 109 | GDGNSDPESTFIPGL | 16 |
| 117 | STFIPGLKKAAEITV | 16 |
| 128 | EITVQPTVEEASDNC | 16 |
| 141 | NCTQECLIYGHSDAC | 16 |
| 154 | ACWMPASLDHSSSSQ | 16 |
| 155 | CWMPASLDHSSSSQA | 16 |
| 161 | LDHSSSSQAQASALC | 16 |
| 163 | HSSSSQAQASALCHS | 16 |
| 168 | QAQASALCHSPPLSQ | 16 |
| 187 | HHSPRVTQTIALCHS | 16 |
| 192 | VTQTIALCHSPPVTQ | 16 |
| 204 | VTQTIALCHSPPPIQ | 16 |
| 214 | PPPIQVSALHHSPPL | 16 |
| 222 | LHHSPPLVQATALHH | 16 |
| 226 | PPLVQATALHHSPPS | 16 |
| 233 | ALHHSPPSAQASALC | 16 |
| 235 | HHSPPSAQASALCYS | 16 |
| 240 | SAQASALCYSPPLAQ | 16 |
| 246 | LCYSPPLAQAAAISH | 16 |
| 249 | SPPLAQAAAISHSSP | 16 |
| 258 | ISHSSPLPQVIALHR | 16 |
| 268 | IALHRSQAQSSVSLQ | 16 |
| 292 | LCSVDQGVQGSATSQ | 16 |
| 300 | QGSATSQFYTMSERL | 16 |
| 323 | VIPLTTFTPRQQARP | 16 |
| 7 | PVSVHTRPPMKEVVR | 15 |
| 13 | RPPMKEVVRSCTPMK | 15 |
| 16 | MKEVVRSCTPMKEST | 15 |
| 47 | KVAGKSQRRVTFHLP | 15 |

TABLE XLVI-continued

109P1D4v.3-DRB1 0101-15-mers
Each peptide is a portion of SEQ ID NO: 7; each start position is specified, the length of peptide is 15 amino acids, and the end position for each peptide is the start position plus fourteen

| | | |
|---|---|---|
| 56 | VTFHLPEGSQESSSD | 15 |
| 72 | GLGDHDAGSLTSTSH | 15 |
| 75 | DHDAGSLTSTSHGLP | 15 |
| 85 | SHGLPLGYPQEEYFD | 15 |
| 142 | CTQECLIYGHSDACW | 15 |
| 156 | WMPASLDHSSSSQAQ | 15 |
| 169 | AQASALCHSPPLSQA | 15 |
| 181 | SQASTQHHSPRVTQT | 15 |
| 186 | QHHSPRVTQTIALCH | 15 |
| 198 | LCHSPPVTQTIALCH | 15 |
| 212 | HSPPPIQVSALHHSP | 15 |
| 217 | IQVSALHHSPPLVQA | 15 |
| 229 | VQATALHHSPPSAQA | 15 |
| 241 | AQASALCYSPPLAQA | 15 |
| 265 | PQVIALHRSQAQSSV | 15 |
| 312 | ERLHPSDDSIKVIPL | 15 |

TABLE XLVII

109P1D4v.3-DRB1 0301 15-mers
Each peptide is a portion of SEQ ID NO: 7; each start position is specified, the length of peptide is 15 amino acids, and the end position for each peptide is the start position plus fourteen

| | | |
|---|---|---|
| 108 | EGDGNSDPESTFIPG | 26 |
| 87 | GLPLGYPQEEYFDRA | 24 |
| 318 | DDSIKVIPLTTFTPR | 20 |
| 33 | EIWIHPQPQRKSEGK | 19 |
| 117 | STFIPGLKKAAEITV | 19 |
| 13 | RPPMKEVVRSCTPMK | 18 |
| 57 | TFHLPEGSQESSSDG | 18 |
| 70 | DGGLGDHDAGSLTST | 18 |
| 116 | ESTFIPGLKKAAEIT | 18 |
| 128 | EITVQPTVEEASDNC | 18 |
| 296 | DQGVQGSATSQFYTM | 18 |
| 31 | TMEIWIHPQPQRKSE | 17 |
| 45 | EGKVAGKSQRRVTFH | 17 |
| 47 | KVAGKSQRRVTFHLP | 17 |
| 86 | HGLPLGYPQEEYFDR | 17 |

TABLE XLVII-continued

109P1D4v.3-DRB1 0301 15-mers
Each peptide is a portion of SEQ ID NO: 7; each start position is specified, the length of peptide is 15 amino acids, and the end position for each peptide is the start position plus fourteen

| 104 | SNRTEGDGNSDPEST | 17 |
|---|---|---|
| 120 | IPGLKKAAEITVQPT | 17 |
| 264 | LPQVIALHRSQAQSS | 17 |
| 289 | ADGLCSVDQGVQGSA | 17 |
| 326 | LTTFTPRQQARPSRG | 17 |
| 5 | EVPVSVHTRPPMKEV | 16 |
| 292 | LCSVDQGVQGSATSQ | 16 |
| 304 | TSQFYTMSERLHPSD | 16 |
| 78 | AGSLTSTSHGLPLGY | 14 |
| 136 | EEASDNCTQECLIYG | 14 |
| 17 | KEVVRSCTPMKESTT | 13 |
| 64 | SQESSSDGGLGDHDA | 13 |
| 69 | SDGGLGDHDAGSLTS | 13 |
| 126 | AAEITVQPTVEEASD | 13 |
| 132 | QPTVEEASDNCTQEC | 13 |
| 243 | ASALCYSPPLAQAAA | 13 |
| 265 | PQVIALHRSQAQSSV | 13 |

TABLE XLIX

109P1D4v.3 DRB1 1101-15-mers
Each peptide is a portion of SEQ ID NO: 7; each start position is specified, the length of peptide is 15 amino acids, and the end position for each peptide is the start position plus fourteen

| 13 | RPPMKEVVRSCTPMK | 26 |
|---|---|---|
| 264 | LPQVIALHRSQAQSS | 26 |
| 289 | ADGLCSVDQGVQGSA | 26 |
| 1 | VTTFEVPVSVHTRPP | 22 |
| 153 | DACWMPASLDHSSSS | 22 |
| 5 | EVPVSVHTRPPMKEV | 20 |
| 16 | MKEVVRSCTPMKEST | 20 |
| 23 | CTPMKESTTMEIWIH | 20 |
| 33 | EIWIHPQPQRKSEGK | 20 |
| 57 | TFHLPEGSQESSSDG | 20 |
| 120 | IPGLKKAAEITVQPT | 20 |
| 132 | QPTVEEASDNCTQEC | 20 |
| 158 | PASLDHSSSSQAQAS | 20 |
| 177 | SPPLSQASTQHHSPR | 20 |
| 193 | TQTIALQHSPPVTQT | 20 |

TABLE XLIX-continued

109P1D4v.3 DRB1 1101-15-mers
Each peptide is a portion of SEQ ID NO: 7; each start position is specified, the length of peptide is 15 amino acids, and the end position for each peptide is the start position plus fourteen

| 216 | PIQVSALHHSPPLVQ | 20 |
|---|---|---|
| 265 | PQVIALHRSQAQSSV | 20 |
| 283 | QGWVQGADGLCSVDQ | 20 |
| 292 | LCSVDQGVQGSATSQ | 20 |
| 320 | SIKVIPLTTFTPRQQ | 20 |
| 323 | VIPLTTFTPRQQARP | 20 |
| 56 | VTFHLPEGSQESSSD | 18 |
| 72 | GLGDHDAGSLTSTSH | 18 |
| 155 | CWMPASLDHSSSSQA | 18 |
| 156 | WMPASLDHSSSSQAQ | 18 |
| 174 | LCHSPPLSQASTQHH | 18 |
| 186 | QHHSPRVTQTIALCH | 18 |
| 198 | LCHSPPVTQTIALCH | 18 |
| 222 | LHHSPPLVQATALHH | 18 |
| 246 | LCYSPPLAQAAAISH | 18 |
| 251 | PLAQPAAISHSSPLP | 18 |
| 258 | ISHSSPLPQVIALHR | 18 |
| 263 | PLPQVIALHRSQAQS | 18 |
| 269 | ALHRSQAQSSVSLQQ | 18 |
| 275 | AQSSVSLQQGWVQGA | 18 |
| 286 | VQGADGLCSVDQGVQ | 18 |
| 312 | ERLHPSDDSIKVIPL | 18 |
| 94 | QEEYFDRATPSNRTE | 17 |
| 32 | MEIWIHPQPQRKSEG | 16 |
| 89 | PLGYPQEEYFDRATP | 16 |
| 95 | EEYFDRATPSNRTEG | 16 |
| 116 | ESTFIPGLKKAAEIT | 16 |
| 146 | CLIYGHSDACWMPAS | 16 |
| 245 | ALCYSPPLAQAAAIS | 16 |
| 305 | SQFYTMSERLHPSDD | 16 |
| 45 | EGKVAGKSQRRVTFH | 15 |
| 3 | TFEVPVSVHTRPPMK | 14 |
| 29 | STTMEIWIHPQPQRK | 14 |
| 31 | TMEIWIHPQPQRKSE | 14 |
| 53 | QRRVTFHLPEGSQES | 14 |
| 70 | DGGLGDHDAGSLTST | 14 |
| 78 | AGSLTSTSHGLPLGY | 14 |

TABLE XLIX-continued

109P1D4v.3 DRB1 1101-15-mers
Each peptide is a portion of SEQ ID NO: 7; each start position is specified, the length of peptide is 15 amino acids, and the end position for each peptide is the start position plus fourteen

| | | |
|---|---|---|
| 117 | STFIPGLKKAAEITV | 14 |
| 126 | AAEITVQPTVEEASD | 14 |
| 128 | EITVQPTVEEASDNC | 14 |
| 144 | QECLIYGHSDACWMP | 14 |
| 154 | ACWMPASLDHSSSSQ | 14 |
| 171 | ASALCHSPPLSQAST | 14 |
| 195 | TIALCHSPPVTQTIA | 14 |
| 205 | TQTIALCHSPPPIQV | 14 |
| 207 | TIALCHSPPPIQVSA | 14 |
| 214 | PPPIQVSALHHSPPL | 14 |
| 219 | VSALHHSPPLVQATA | 14 |
| 225 | SPPLVQATALHHSPP | 14 |
| 226 | PPLVQATALHHSPPS | 14 |
| 231 | ATALHHSPPSAQASA | 14 |
| 243 | ASALCYSPPLAQAAA | 14 |
| 249 | SPPLAQAAAISHSSP | 14 |
| 255 | AAAISHSSPLPQVIA | 14 |
| 261 | SSPLPQVIALHRSQA | 14 |
| 267 | VIALHRSQAQSSVSL | 14 |
| 276 | QSSVSLQQGWVQGAD | 14 |
| 278 | SVSLQQGWVQGADGL | 14 |
| 296 | DQGVQGSATSQFYTM | 14 |
| 311 | SERLHPSDDSIKVIP | 14 |
| 318 | DDSIKVIPLTTFTPR | 14 |

TABLE XXVII

109P1D4v.4-B0702 9-mers
Each peptide is a portion of SEQ ID NO: 9; each start position is specified, the length of peptide is 9 amino acids, and the end position for each peptide is the start position plus eight

| | | |
|---|---|---|
| 6 | QPQSQRRVT | 18 |
| 4 | HPQPQSQRR | 11 |
| 7 | PQSQRRVTF | 11 |

TABLE XXII

109P1D4v.4-A1 9-mers
Each peptide is a portion of SEQ ID NO: 9; each start position is specified, the length of peptide is 9 amino acids, and the end position for each peptide is the start position plus eight

| | | |
|---|---|---|
| 6 | WIHPQPQSQ | 6 |
| 4 | HPQPQSQRR | 6 |
| 8 | QSQRRVTFH | 5 |
| 6 | QPQSQRRVT | 4 |

TABLE XXIII

109P1D4v.4-A0201 9-mers
Each peptide is a portion of SEQ ID NO: 9; each start position is specified, the length of peptide is 9 amino acids, and the end position for each peptide is the start position plus eight

| | | |
|---|---|---|
| 2 | WIHPQPQSQ | 12 |
| 5 | PQPQSQRRV | 7 |
| 1 | IWIHPQPQS | 6 |

TABLE XXIV

109P1D4v.4-A0203 9-mers

No Results Found.

TABLE XXV

109P1D4v.4 A3-9-mers
Each peptide is a portion of SEQ ID NO: 9; each start position is specified, the length of peptide is 9 amino acids, and the end position for each peptide is the start position plus eight

| | | |
|---|---|---|
| 7 | PQSQRRVTF | 15 |
| 2 | WIHPQPQSQ | 14 |
| 3 | IHPQPQSQR | 12 |
| 8 | QSQRRVTFH | 12 |
| 1 | IWIHPQPQS | 8 |

TABLE XXVI

109P1D4v.4-A26 9-mers
Each peptide is a portion of SEQ ID NO: 9; each start position is specified, the length of peptide is 9 amino acids, and the end position for each peptide is the start position plus eight

| | | |
|---|---|---|
| 7 | PQSQRRVTF | 9 |
| 2 | WIHPQPQSQ | 6 |
| 1 | IWIHPQPQS | 5 |

TABLE XXVIII

109P1D4v.4-B08 9-mers
Each peptide is a portion of SEQ ID NO: 9;
each start position is specified, the length
of peptide is 9 amino acids, and the end position
for each peptide is the start position plus eight

| | | |
|---|---|---|
| 7 | PQSQRRVTF | 15 |
| 8 | QSQRRVTFH | 9 |
| 4 | HPQPQSQRR | 7 |

TABLE XXIX

109P1D4v.4 B1510 9-mers
Each peptide is a portion of SEQ ID NO: 9;
each start position is specified, the length
of peptide is 9 amino acids, and the end position
for each peptide is the start position plus eight

| | | |
|---|---|---|
| 3 | IHPQPQSQR | 14 |
| 7 | PQSQRRVTF | 12 |

TABLE XXX

109P1D4v.4-B2705 9-mers
Each peptide is a portion of SEQ ID NO: 9;
each start position is specified, the length
of peptide is 9 amino acids, and the end position
for each peptide is the start position plus eight

| | | |
|---|---|---|
| 3 | IHPQPQSQR | 18 |
| 4 | HPQPQSQRR | 14 |
| 7 | PQSQRRVTF | 14 |
| 8 | QSQRRVTFH | 11 |

TABLE XXXI

109P1D4v.4 B2709-9-mers
Each peptide is a portion of SEQ ID NO: 9;
each start position is specified, the length
of peptide is 9 amino acids, and the end position
for each peptide is the start position plus eight

| | | |
|---|---|---|
| 5 | PQPQSQRRV | 9 |
| 7 | PQSQRRVTF | 9 |
| 1 | IWIHPQPQS | 4 |

TABLE XXXII

109P1D4v.4
B4402-9-mers
Each peptide is a
portion of SEQ ID
NO: 9; each start
position is specified,
the length of
peptide is 9 amino
acids, and the end
position for each
peptide is the start
position plus eight

| | | |
|---|---|---|
| 7 | PQSQRRVTF | 15 |
| 1 | IWIHPQPQS | 4 |

TABLE XXXIII

109P1D4v.4-B5101
9-mers
Each peptide is a
portion of SEQ ID
NO: 9; each start
position is specified,
the length of peptide
is 9 amino acids,
and the end position
for each peptide is
the start posiUon
plus eight

| | | |
|---|---|---|
| 6 | QPQSQRRVT | 14 |
| 5 | PQPQSQRRV | 12 |
| 4 | HPQPQSQRR | 11 |

TABLE XXXIV

109P1D4v.4-A1
10-mers
Each peptide is a
portion of SEQ ID
NO: 9; each start
position is specified,
the length of peptide
is 10 amino acids,
and the end position
for each peptide is
the start position
plus nine

| | | |
|---|---|---|
| 3 | WIHPQPQSQR | 4 |
| 5 | HPQPQSQRRV | 4 |
| 9 | QSQRRVTFHL | 4 |
| 6 | PQPQSQRRVT | 2 |

TABLE XXXV

109P1D4v.4-A0201
10-mers
Each peptide is a
portion of SEQ ID NO:
9; each start position
is specified, the length
of peptide is 10 amino
acids, and the end
position for each
peptide is the start
position plus nine

| | | |
|---|---|---|
| 5 | HPQPQSQRRV | 12 |
| 3 | WIHPQPQSQR | 10 |
| 9 | QSQRRVTFHL | 10 |
| 1 | EIWIHPQPQS | 7 |
| 2 | IWIHPQPQSQ | 6 |

TABLE XXXVI

| 109P1D4v.4-A0203 10-mers |
|---|
| No Results Found. |

TABLE XXXVII

109P1D4v.4
A3-10-mers
Each peptide is a portion of SEQ ID NO: 9; each start position is specified, the length of peptide is 10 amino acids, and the end position for each peptide is the start position plus nine

| | | |
|---|---|---|
| 3 | WIHPQPQSQR | 21 |
| 7 | QPQSQRRVTF | 15 |
| 1 | EIWIHPQPQS | 12 |

TABLE XXXVIII

109P1D4v.4-A26
10-mers
Each peptide is a portion of SEQ ID NO: 9; each start position is specified, the length of peptide is 10 amino acids, and the end position for each peptide is the start position plus nine

| | | |
|---|---|---|
| 1 | EIWIHPQPQS | 15 |
| 7 | QPQSQRRVTF | 10 |
| 9 | QSQRRVTFHL | 8 |
| 3 | WIHPQPQSQR | 7 |

TABLE XXXIX

109P1D4v.4-B0702
10-mers
Each peptide is a portion of SEQ ID NO: 9; each start position is specified, the length of peptide is 10 amino acids, and the end position for each peptide is the start position plus nine

| | | |
|---|---|---|
| 7 | QPQSQRRVTF | 19 |
| 5 | HPQPQSQRRV | 17 |
| 9 | QSQRRVTFHL | 11 |

TABLE XL

109P1D4v.4-B08-10-mers

No Results Found.

TABLE XLI

109P1D4v.4-B1510 10-mers

No Results Found.

TABLE XLII

109P1D4v.4-B2705 10-mers

No Results Found.

TABLE XLIII

109P1D4v.4-B2709 10-mers

No Results Found.

TABLE XLIV

109P1D4v.4-B4402
10-mers
Each peptide is a portion of SEQ ID NO: 9; each start position is specified, the length of peptide is 10 amino acids, and the end position for each peptide is the start posiion plus nine

| | | |
|---|---|---|
| 7 | QPQSQRRVTF | 13 |
| 9 | QSQRRVTFHL | 12 |

TABLE XLV

109P1D4v.4-B5101
10-mers

No Results Found.

TABLE XLVI

109P1D4v.4
DRB1 0101-15-mers
Each peptide is a portion of SEQ ID NO: 9; each start position is specified, the length of peptide is 15 amino acids, and the end position for each peptide is the start posiUon plus fourteen

| | | |
|---|---|---|
| 2 | STTMEIWIHPQPQSQ | 19 |
| 4 | TMEIWIHPQPQSQRR | 19 |
| 5 | MEIWIHPQPQSQRRV | 16 |
| 13 | PQSQRRVTFHLPEGS | 16 |
| 8 | WIHPQPQSQRRVTFH | 15 |
| 6 | EIWIHPQPQSQRRVT | 14 |
| 10 | HPQPQSQRRVTFHLP | 14 |

TABLE XLVI-continued

109P1D4v.4
DRB1 0101-15-mers
Each peptide is a portion of SEQ ID NO: 9; each start position is specified, the length of peptide is 15 amino acids, and the end position for each peptide is the start posiUon plus fourteen

| | | |
|---|---|---|
| 12 | QPQSQRRVTFHLPEG | 14 |
| 3 | TTMEIWIHPQPQSQR | 12 |

TABLE XLVII

109P1D4v.4
DRB1 0301-15-mers
Each peptide is a portion of SEQ ID NO: 9; each start position is specified, the length of peptide is 15 amino acids, and the end position for each peptide is the start position plus fourteen

| | | |
|---|---|---|
| 6 | EIWIHPQPQSQRRVT | 18 |
| 4 | TMEIWIHPQPQSQRR | 17 |
| 10 | HPQPQSQRRVTFHLP | 16 |
| 2 | STTMEIWIHPQPQSQ | 10 |

TABLE XLVIII

109P1D4v.4
DRB1 0401-15-mers
Each peptide is a portion of SEQ ID NO: 9; each start position is specified, the length of peptide is 15 amino acids, and the end position for each peptide is the start position plus fourteen

| | | |
|---|---|---|
| 4 | TMEIWIHPQPQSQRR | 20 |
| 5 | MEIWIHPQPQSQRRV | 16 |
| 2 | STTMEIWIHPQPQSQ | 14 |
| 6 | EIWIHPQPQSQRRVT | 14 |
| 1 | ESTTMEIWIHPQPQS | 12 |
| 3 | TTMEIWIHPQPQSQR | 12 |
| 8 | WIHPQPQSQRRVTFH | 12 |
| 9 | IHPQPQSQRRVTFHL | 12 |

TABLE XLIX

109P1D4v.4
DRB1 1101-15-mers
Each peptide is a portion of SEQ ID NO: 9; each start position is specified, the length of peptide is 15 amino acids, and the end position for each peptide is the start position plus fourteen

| | | |
|---|---|---|
| 2 | STTMEIWIHPQPQSQ | 20 |
| 13 | PQSQRRVTFHLPEGS | 13 |
| 4 | TMEIWIHPQPQSQRR | 12 |
| 5 | MEIWIHPQPQSQRRV | 10 |
| 9 | IHPQPQSQRRVTFHL | 10 |

TABLE XXII

109P1D4v.5-A1
9-mers
Each peptide is a portion of SEQ ID NO: 11; each start position is specified, the length of peptide is 9 amino acids, and the end postion for each peptide is the start position plus eight

| | | |
|---|---|---|
| 5 | HTRPSQRRV | 10 |
| 2 | VSVHTRPSQ | 6 |
| 8 | PSQRRVTFH | 5 |

TABLE XXIII

109P1D4v.5
A0201-9-mers
Each peptide is a portion of SEQ ID NO: 11; each start position is specified, the length of peptide is 9 amino acids, and the end position for each peptide is the start position plus eight

| | | |
|---|---|---|
| 5 | HTRPSQRRV | 16 |
| 3 | SVHTRPSQR | 6 |

TABLE XXIV

109P1D4v.5 A0203-9-mers

No Results Found

TABLE XXV

109P1D4v.5-A3
9-mers
Each peptide is a portion of SEQ ID NO: 11; each start position is specified, the length of peptide is 9 amino acids, and the end position for each peptide is the start position plus eight

| | | |
|---|---|---|
| 3 | SVHTRPSQR | 24 |
| 7 | RPSQRRVTF | 19 |

TABLE XXVI

109P1D4v.5-A26
9-mers
Each peptide is a portion of SEQ ID NO: 11; each start position is specified, the length of peptide is 9 amino acids, and the end position for each peptide is the start position plus eight

| | | |
|---|---|---|
| 3 | SVHTRPSQR | 13 |
| 1 | PVSVHTRPS | 10 |
| 5 | HTRPSQRRV | 9 |
| 7 | RPSQRRVTF | 9 |

TABLE XXVII

109P1D4v.5
B0702-9-mers
Each peptide is a portion of SEQ ID NO: 11; each start position is specified, the length of peptide is 9 amino acids, and the end position for each peptide is the start position plus eight

| | | |
|---|---|---|
| 7 | RPSQRRVTF | 22 |
| 5 | HTRPSQRRV | 9 |

TABLE XXVIII

109P1D4v.5
B08-9-mers
Each peptide is a portion of SEQ ID NO: 11; each start position is specified, the length of peptide is 9 amino acids, and the end position for each peptide is the start position plus eight

| | | |
|---|---|---|
| 7 | RPSQRRVTF | 21 |
| 3 | SVHTRPSQR | 10 |

TABLE XXIX

109P1D4v.5
B1510-9-mers
Each peptide is a portion of SEQ ID NO: 11; each start position is specified, the length of pepTIde is 9 amino acids, and the end position for each peptide is the start position plus eight

| | | |
|---|---|---|
| 4 | VHTRPSQRR | 13 |
| 7 | RPSQRRVTF | 12 |
| 5 | HTRPSQRRV | 6 |
| 6 | TRPSQRRVT | 6 |

TABLE XXX

109P1D4v.5 B2705-9-mers
Each peptide is a portion of SEQ ID NO: 11; each start position is specified, the length of peptide is 9 amino acids, and the end position for each peptide is the start position plus eight

| | | |
|---|---|---|
| 7 | RPSQRRVTF | 18 |
| 4 | VHTRPSQRR | 14 |
| 3 | SVHTRPSQR | 12 |
| 6 | TRPSQRRVT | 11 |
| 8 | PSQRRVTFH | 11 |

TABLE XXXI

109P1D4v.5 B2709-9-mers
Each peptide is a portion of SEQ ID NO: 11; each start position is specified, the length of peptide is 9 amino acids, and the end position for each peptide is the start position plus eight

| | | |
|---|---|---|
| 7 | RPSQRRVTF | 13 |
| 6 | TRPSQRRVT | 11 |
| 5 | HTRPSQRRV | 10 |

TABLE XXXII

109P1D4v.5 B4402-9-mers
Each peptide is a portion of SEQ ID NO: 11;
each start position is specified, the length of
peptide is 9 amino acids, and the end position
for each peptide is the start position plus eight

| | | |
|---|---|---|
| 7 | RPSQRRVTF | 15 |
| 3 | SVHTRPSQR | 5 |

TABLE XXXIII

109P1D4v.5 B5101-9-mers
Each peptide is a portion of SEQ ID NO: 11;
each start position is specified, the length of
peptide is 9 amino acids, and the end position
for each peptide is the start position plus eight

| | | |
|---|---|---|
| 7 | RPSQRRVTF | 13 |
| 5 | HTRPSQRRV | 11 |
| 6 | TRPSQRRVT | 6 |

TABLE XXXIV

109P1D4v.5 A1 10-mers
Each peptide is a portion of SEQ ID NO: 11;
each start position is specified, the length of
peptide is 10 amino acids, and the end position
for each peptide is the start position plus nine

| | | |
|---|---|---|
| 7 | HTRPSQRRVT | 12 |
| 3 | VSVHTRPSQR | 5 |

TABLE XXXV

109P1D4v.5 A0201-10-mers
Each peptide is a portion of SEQ ID NO: 11;
each start position is specified, the length of
peptide is 10 amino acids, and the end position
for each peptide is the start position plus nine

| | | |
|---|---|---|
| 5 | VHTRPSQRRV | 10 |
| 6 | HTRPSQRRVT | 10 |
| 9 | PSQRRVTFHL | 7 |
| 4 | SVHTRPSQRR | 6 |

TABLE XXXVI

109P1D4v.5 A0203-10-mers

No Results Found.

TABLE XXXVII

109P1D4v.5 A3 10-mers
Each peptide is a portion of SEQ ID NO: 11;
each start position is specified, the length of
peptide is 10 amino acids, and the end position
for each peptide is the start position plus nine

| | | |
|---|---|---|
| 4 | SVHTRPSQRR | 15 |
| 2 | PVSVHTRPSQ | 13 |
| 7 | TRPSQRRVTF | 13 |

TABLE XXXVII-continued

109P1D4v.5 A3 10-mers
Each peptide is a portion of SEQ ID NO: 11;
each start position is specified, the length of
peptide is 10 amino acids, and the end position
for each peptide is the start position plus nine

| | | |
|---|---|---|
| 3 | VSVHTRPSQR | 11 |
| 6 | HTRPSQRRVT | 11 |

TABLE XXXVIII

109P1D4v.5 A26-10-mers
Each peptide is a portion of SEQ ID NO: 11;
each start position is specified, the length of
peptide is 10 amino acids, and the end position
for each peptide is the start position plus nine

| | | |
|---|---|---|
| 2 | PVSVHTRPSQ | 11 |
| 4 | SVHTRPSQRR | 11 |
| 7 | TRPSQRRVTF | 11 |
| 6 | HTRPSQRRVT | 9 |
| 9 | PSQRRVTFHL | 8 |
| 3 | VSVHTRPSQR | 6 |

TABLE XXXIX

109P1D4v.5 B0702-10-mers
Each peptide is a portion of SEQ ID NO: 11;
each start position is specified, the length of
peptide is 10 amino acids, and the end position
for each peptide is the start position plus nine

| | | |
|---|---|---|
| 8 | RPSQRRVTFH | 16 |
| 1 | VPVSVHTRPS | 12 |
| 6 | HTRPSQRRVT | 11 |
| 9 | PSQRRVTFHL | 11 |
| 7 | TRPSQRRVTF | 9 |

TABLE XL

109P1D4v.5 B08-10-mers

No Results Found.

TABLE XLI

109P1D4v.5 B1510-10-mers

No Results Found.

TABLE XLII

109P1D4v.5 B2705-10-mers

No Results Found.

TABLE XLIII

109P1D4v.5 B2709-10-mers

No Results Found.

TABLE XLIV

109P1D4v.5-B4402 10-mers
Each peptide is a portion of SEQ ID NO: 11;
each start position is specified, the length of
peptide is 10 amino acids, and the end position
for each peptide is the start position plus nine

| | | |
|---|---|---|
| 7 | TRPSQRRVTF | 14 |
| 9 | PSQRRVTFHL | 12 |

TABLE XLV

109P1D4v.5 B5101-10-mers

No Results Found.

TABLE XLVI

109P1D4v.5 DRB1 0101-15-mers
Each peptide is a portion of SEQ ID NO: 11; each
start position is specified, the length of peptide
is 15 amino acids, and the end position for
each peptide is the start position plus fourteen

| | | |
|---|---|---|
| 4 | FEVPVSVHTRPSQRR | 22 |
| 3 | TFEVPVSVHTRPSQR | 17 |
| 1 | VTTFEVPVSVHTRPS | 16 |
| 13 | RPSQRRVTFHLPEGS | 16 |
| 7 | PVSVHTRPSQRRVTF | 14 |
| 10 | VHTRPSQRRVTFHLP | 14 |
| 12 | TRPSQRRVTFHLPEG | 14 |

TABLE XLVII

109P1D4v.5 DRB1 0301-15-mers
Each peptide is a portion of SEQ ID NO: 11; each
start position is specified, the length of peptide
is 15 amino acids, and the end position for
each peptide is the start position plus fourteen

| | | |
|---|---|---|
| 5 | EVPVSVHTRPSQRRV | 16 |
| 10 | VHTRPSQRRVTFHLP | 16 |
| 7 | PVSVHTRPSQRRVTF | 12 |
| 3 | TFEVPVSVHTRPSQR | 10 |
| 1 | VTTFEVPVSVHTRPS | 9 |

TABLE XLVII-continued

109P1D4v.5 DRB1 0301-15-mers
Each peptide is a portion of SEQ ID NO: 11; each
start position is specified, the length of peptide
is 15 amino acids, and the end position for
each peptide is the start position plus fourteen

| | | |
|---|---|---|
| 8 | VSVHTRPSQRRVTFH | 8 |
| 9 | SVHTRPSQRRVTFHL | 8 |
| 12 | TRPSQRRVTFHLPEG | 8 |

TABLE XLVIII

109P1D4v.5 DRB1 0401-15-mers
Each peptide is a portion of SEQ ID NO: 11; each
start position is specified, the length of peptide
is 15 amino acids, and the end position for
each peptide is the start position plus fourteen

| | | |
|---|---|---|
| 1 | VTTFEVPVSVHTRPS | 22 |
| 5 | EVPVSVHTRPSQRRV | 20 |
| 4 | FEVPVSVHTRPSQRR | 18 |
| 3 | TFEVPVSVHTRPSQR | 14 |
| 8 | VSVHTRPSQRRVTFH | 12 |
| 9 | SVHTRPSQRRVTFHL | 12 |

TABLE XLIX

109P1D4v.5 DRB1 1101-15-mers
Each peptide is a portion of SEQ ID NO: 11; each
start position is specified, the length of peptide
is 15 amino acids, and the end position for
each peptide is the start position plus fourteen

| | | |
|---|---|---|
| 3 | TFEVPVSVHTRPSQR | 25 |
| 5 | EVPVSVHTRPSQRRV | 15 |
| 1 | VTTFEVPVSVHTRPS | 13 |
| 4 | FEVPVSVHTRPSQRR | 13 |
| 13 | RPSQRRVTFHLPEGS | 13 |

TABLE XXII

109P1D4v.6 C' terminal-A1 9-mers
Each peptide is a portion of SEQ ID NO: 13;
each start position is specified, the length of
peptide is 9 amino acids, and the end position for
each peptide is the start position plus eight

| | | |
|---|---|---|
| 5 | HT̲RPTD̲SRT | 10 |
| 2 | VS̲VHTRP̲TD | 6 |

TABLE XXIII

109P1D4v.6 C' terminal-A0201 9-mers
Each peptide is a portion of SEQ ID NO: 13;
each start position is specified, the length of
peptide is 9 amino acids, and the end position for
each peptide is the start position plus eight

| | | |
|---|---|---|
| 5 | HTRPTD̲SRT | 10 |
| 1 | PVSVHT̲RPT | 7 |

TABLE XXIII-continued

109P1D4v.6 C' terminal-A0201 9-mers
Each peptide is a portion of SEQ ID NO: 13;
each start position is specified, the length of
peptide is 9 amino acids, and the end position for
each peptide is the start position plus eight

| 3 | SVHTRPTDS | 6 |
| 4 | VHTRPTDSR | 5 |

TABLE XXIV

109P1D4v.6 C' terminal-A0203 9-mers

No Results Found.

TABLE XXV

109P1D4v.6 C' terminal-A3 9-mers
Each peptide is a portion of SEQ ID NO: 13;
each start position is specified, the length of
peptide is 9 amino acids, and the end position for
each peptide is the start position plus eight

| 3 | SVHTRPTDS | 15 |
| 1 | PVSVHTRPT | 10 |
| 4 | VHTRPTDSR | 9 |
| 5 | HTRPTDSRT | 9 |

TABLE XXVI

109P1D4v.6 C' terminal A26-9-mers
Each peptide is a portion of SEQ ID NO: 13;
each start position is specified, the length of
peptide is 9 amino acids, and the end position for
each peptide is the start position plus eight

| 3 | SVHTRPTDS | 11 |
| 1 | PVSVHTRPT | 10 |
| 5 | HTRPTDSRT | 10 |
| 2 | VSVHTRPTD | 5 |

TABLE XXVII

109P1D4v.6 C' terminal-B0702 9-mers
Each peptide is a portion of SEQ ID NO: 13;
each start position is specified, the length of
peptide is 9 amino acids, and the end position for
each peptide is the start position plus eight

| 1 | PVSVHTRPT | 10 |
| 5 | HTRPTDSRT | 9 |
| 4 | VHTRPTDSR | 4 |

TABLE XXVIII

109P1D4v.6 C' terminal-B08 9-mers
Each peptide is a portion of SEQ ID NO: 13;
each start position is specified, the length of
peptide is 9 amino acids, and the end position for
each peptide is the start position plus eight

| 3 | SVHTRPTDS | 10 |
| 5 | HTRPTDSRT | 7 |

TABLE XXIX

109P1D4v.6 C' terminal B1510-9-mers
Each peptide is a portion of SEQ ID NO: 13; each start position is specified, the length of peptide is 9 amino acids, and the end position for each peptide is the start position plus eight

| 4 | VHTRPTDSR | 11 |
| 1 | PVSVHTRPT | 4 |
| 5 | HTRPTDSRT | 4 |

TABLE XXX

109P1D4v.6 C' terminal-B2705 9-mers
Each peptide is a portion of SEQ ID NO: 13; each start position is specified, the length of peptide is 9 amino acids, and the end position for each peptide is the start position plus eight

| 4 | VHTRPTDSR | 12 |
| 5 | HTRPTDSRT | 5 |

TABLE XXXI

109P1D4v.6 C' terminal-B2709 9-mers
Each peptide is a portion of SEQ ID NO: 13; each start position is specified, the length of peptide is 9 amino acids, and the end position for each peptide is the start position plus eight

| 2 | VSVHTRPTD | 2 |
| 5 | HTRPTDSRT | 2 |
| 4 | VHTRPTDSR | 1 |

TABLE XXXII

109P1D4v.6
C' terminal-B4402
9-mers
Each peptide is a portion of SEQ ID NO: 13; each start position is specified, the length of peptide is 9 amino acids, and the end position for each peptide is the start position plus eight

| 3 | SVHTRPTDS | 4 |
|---|---|---|
| 1 | PVSVHTRPT | 3 |
| 5 | HTRPTDSRT | 3 |
| 2 | VSVHTRPTD | 2 |
| 4 | VHTRPTDSR | 2 |

TABLE XXXIII

109P1D4v.6
C' terminal-B5101
9-mers
Each peptide is a portion of SEQ ID NO: 13; each start position is specified, the length of peptide is 9 amino acids, and the end position for each peptide is the start position plus eight

| 2 | VSVHTRPTD | 4 |
|---|---|---|
| 3 | SVHTRPTDS | 3 |
| 5 | HTRPTDSRT | 2 |

TABLE XXXIV

109P1D4v.6
C' terminal-A1
10-mers
Each peptide is a portion of SEQ ID NO: 13; each start position is specified, the length of peptide is 10 amino acids, and the end position for each peptide is the start position plus nine

| 3 | VSVHTRPTDS | 5 |
|---|---|---|
| 4 | SVHTRPTDSR | 2 |

TABLE XXXV

109P1D4v.6
C' terminal-A0201
10-mers
Each peptide is a portion of SEQ ID NO: 13; each start position is specified, the length of peptide is 10 amino acids, and the end position for each peptide is the start position plus nine

| 4 | SVHTRPTDSR | 8 |
|---|---|---|
| 1 | VPVSVHTRPT | 5 |
| 2 | PVSVHTRPTD | 4 |
| 5 | VHTRPTDSRT | 4 |

TABLE XLVI

109P1D4v.6
C' terminal-DRB1 0101
15-mers
Each peptide is a portion of SEQ ID NO: 13; each start position is specified, the length of peptide is 15 amino acids, and the end position for each peptide is the start position plus fourteen

| 3 | TFEVPVSVHTRPTDS | 17 |
|---|---|---|
| 1 | VTTFEVPVSVHTRPT | 16 |
| 4 | FEVPVSVHTRPTDSR | 14 |
| 5 | EVPVSVHTRPTDSRT | 8 |

TABLE XLVII

109P1D4v.6
C' terminal-DRB1 0301
15-mers
Each peptide is a portion of SEQ ID NO: 13; each start position is specified, the length of peptide is 15 amino acids, and the end posihon for each peptide is the start position plus fourteen

| 5 | EVPVSVHTRPTDSRT | 16 |
|---|---|---|
| 3 | TFEVPVSVHTRPTDS | 10 |
| 1 | VTTFEVPVSVHTRPT | 9 |

TABLE XXXVI

109P1D4v.6 C' terminal-A0203 10-mers

No Results Found.

TABLE XXXVII

109P1D4v.6
C' terminal-A3
10-mers
Each peptide is a portion of SEQ ID NO: 13; each start position is specified, the length of peptide is 10 amino acids, and the end position for each peptide is the start position plus nine

| | | |
|---|---|---|
| 4 | SVHTRPTDSR | 12 |
| 2 | PVSVHTRPTD | 11 |

TABLE XXXVIII

109P1D4v.6 C' terminal-A26 10-mers
Each peptide is a portion of SEQ ID NO: 13; each start position is specified, the length of peptide is 10 amino acids, and the end position for each peptide is the start position plus nine

| | | |
|---|---|---|
| 4 | SVHTRPTDSR | 12 |
| 2 | PVSVHTRPTD | 11 |

TABLE XXXIX

109P1D4v.6 C' terminal-B0702 10-mers
Each peptide is a portion of SEQ ID NO: 13; each start position is specified, the length of peptide is 10 amino acids, and the end position for each peptide is the start position plus nine

| | | |
|---|---|---|
| 1 | VPVSVHTRPT | 18 |
| 5 | VHTRPTDSRT | 6 |

TABLE XL

109P1D4v.6-C' terminal-B08 10-mers

No Results Found.

TABLE XLI

109P1D4v.6-C' terminal B1510-10-mers

No Results Found.

TABLE XLII

109P1D4v.6-C' terminal B2705-10-mers

No Results Found.

TABLE XLIII

109P1D4v.6 C' terminal-B2709 10-mers

No Results Found.

TABLE XLIV

109P1D4v.6 C' terminal-B4402 10-mers
Each peptide is a portion of SEQ ID NO: 13; each start position is specified, the length of peptide is 10 amino acids, and the end position for each peptide is the start position plus nine

| | | |
|---|---|---|
| 2 | PVSVHTRPTD | 3 |
| 4 | SVHTRPTDSR | 3 |
| 1 | VPVSVHTRPT | 2 |

TABLE XLV

109P1D4v.6 C' terminal-B5101 10-mers

No Results Found.

TABLE XLVIII

109P1D4v.6 C' terminal-DRB1 0401 15-mers
Each peptide is a portion of SEQ ID NO: 13; each start position is specified, the length of peptide is 15 amino acids, and the end position for each peptide is the start position plus fourteen

| | | |
|---|---|---|
| 1 | VTTFEVPVSVHTRPT | 22 |
| 4 | FEVPVSVHTRPTDSR | 18 |
| 3 | TFEVPVSVHTRPTDS | 14 |
| 5 | EVPVSVHTRPTDSRT | 14 |

TABLE XLIX

109P1D4v.6 C' terminal-DRB1 1101 15-mers
Each peptide is a portion of SEQ ID NO: 13; each start position is specified, the length of peptide is 15 amino acids, and the end position for each peptide is the start position plus fourteen

| | | |
|---|---|---|
| 3 | TFEVPVSVHTRPTDS | 25 |
| 5 | EVPVSVHTRPTDSRT | 15 |
| 1 | VTTFEVPVSVHTRPT | 13 |

TABLE XXII

109P1D4v.6 N' terminal-A1 9-mers
Each peptide is a portion of SEQ ID NO: 13; each start position is specified, the length of peptide is 9 amino acids, and the end position for each peptide is the start position plus eight

| | | |
|---|---|---|
| 6 | NSDISSVVR | 15 |
| 21 | HKCLLSGTY | 15 |
| 1 | MTVGFNSDI | 8 |
| 17 | TTNCHKCLL | 8 |
| 18 | TNCHKCLLS | 8 |

TABLE XXIII

109P1D4v.6 N' terminal-A0201 9-mers
Each peptide is a portion of SEQ ID NO: 13; each start position is specified, the length of peptide is 9 amino acids, and the end position for each peptide is the start position plus eight

| | | |
|---|---|---|
| 7 | SDISSVVRV | 20 |
| 4 | GFNSDISSV | 18 |
| 23 | CLLSGTYIF | 17 |
| 1 | MTVGFNSDI | 15 |
| 17 | TTNCHKCLL | 15 |
| 10 | SSVVRVNTT | 13 |
| 5 | FNSDISSVV | 12 |
| 16 | NTTNCHKCL | 12 |
| 8 | DISSVVRVN | 11 |
| 22 | KCLLSGTYI | 11 |

TABLE XXIV

109P1D4v.6 N' terminal-A0203 9-mers

No Results Found.

TABLE XXV

109P1D4v.6 N' terminal A3-9-mers
Each peptide is a portion of SEQ ID NO: 13; each start position is specified, the length of peptide is 9 amino acids, and the end position for each peptide is the start position plus eight

| | | |
|---|---|---|
| 14 | RVNTTNCHK | 24 |
| 11 | SVVRVNTTN | 20 |
| 23 | CLLSGTYIF | 18 |
| 12 | VVRVNTTNC | 14 |
| 6 | NSDISSVVR | 13 |
| 8 | DISSVVRVN | 13 |
| 21 | HKCLLSGTY | 12 |

TABLE XXVI

109P1D4v.6 N' terminal-A26 9-mers
Each peptide is a portion of SEQ ID NO: 13; each start position is specified, the length of peptide is 9 amino acids, and the end position for each peptide is the start position plus eight

| | | |
|---|---|---|
| 8 | DISSVVRVN | 17 |
| 16 | NTTNCHKCL | 17 |
| 17 | TTNCHKCLL | 17 |
| 11 | SVVRVNTTN | 16 |
| 1 | MTVGFNSDI | 13 |
| 21 | HKCLLSGTY | 13 |

TABLE XXVI-continued

109P1D4v.6 N' terminal-A26 9-mers
Each peptide is a portion of SEQ ID NO: 13; each start position is specified, the length of peptide is 9 amino acids, and the end position for each peptide is the start position plus eight

| | | |
|---|---|---|
| 2 | TVGFNSDIS | 12 |
| 12 | VVRVNTTNC | 11 |
| 7 | SDISSVVRV | 10 |
| 10 | SSVVRVNTT | 10 |
| 14 | RVNTTNCHK | 10 |
| 23 | CLLSGTYIF | 9 |

TABLE XXVII

109P1D4v.6 N' terminal-B0702 9-mers
Each peptide is a portion of SEQ ID NO: 13; each start position is specified, the length of peptide is 9 amino acids, and the end position for each peptide is the start position plus eight

| | | |
|---|---|---|
| 9 | ISSVVRVNT | 12 |
| 16 | NTTNCHKCL | 10 |
| 17 | TTNCHKCLL | 10 |
| 5 | FNSDISSVV | 9 |
| 7 | SDISSVVRV | 9 |
| 22 | KCLLSGTYI | 9 |
| 1 | MTVGFNSDI | 8 |
| 10 | SSVVRVNTT | 7 |
| 23 | CLLSGTYIF | 7 |
| 4 | GFNSDISSV | 6 |
| 20 | CHKCLLSGT | 6 |

TABLE XXVIII

109P1D4v.6 N' terminal-B08 9-mers
Each peptide is a portion of SEQ ID NO: 13; each start position is specified, the length of peptide is 9 amino acids, and the end position for each peptide is the start position plus eight

| | | |
|---|---|---|
| 10 | SSVVRVNTT | 12 |
| 23 | CLLSGTYIF | 12 |
| 16 | NTTNCHKCL | 11 |
| 17 | TTNCHKCLL | 10 |
| 18 | TNCHKCLLS | 10 |
| 20 | CHKCLLSGT | 10 |
| 12 | VVRVNTTNC | 8 |
| 1 | MTVGFNSDI | 7 |
| 22 | KCLLSGTYI | 7 |

TABLE XXIX

109P1D4v.6 N' terminal-B1510 9-mers
Each peptide is a portion of SEQ ID NO: 13;
each start position is specified, the length
of peptide is 9 amino acids, and the end position
for each peptide is the start position plus eight

| 17 | TTNCHKCLL | 12 |
|---|---|---|
| 16 | NTTNCHKCL | 10 |
| 20 | CHKCLLSGT | 10 |
| 9 | ISSVVRVNT | 7 |
| 23 | CLLSGTYIF | 7 |
| 8 | DISSVVRVN | 6 |

TABLE XXX

109P1D4v.6 N' terminal-B2705 9-mers
Each peptide is a portion of SEQ ID NO: 13;
each start position is specified, the length
of peptide is 9 amino acids, and the end position
for each peptide is the start position plus eight

| 13 | VRVNTTNCH | 20 |
|---|---|---|
| 14 | RVNTTNCHK | 15 |
| 23 | CLLSGTYIF | 15 |
| 6 | NSDISSVVR | 14 |
| 22 | KCLLSGTYI | 14 |
| 21 | HKCLLSGTY | 12 |
| 1 | MTVGFNSDI | 11 |
| 17 | TTNCHKCLL | 11 |
| 16 | NTTNCHKCL | 10 |

TABLE XXXI

109P1D4v.6 N' terminal-B2709 9-mers
Each peptide is a portion of SEQ ID NO: 13;
each start position is specified, the length
of peptide is 9 amino acids, and the end position
for each peptide is the start position plus eight

| 4 | GFNSDISSV | 13 |
|---|---|---|
| 7 | SDISSVVRV | 13 |
| 22 | KCLLSGTYI | 12 |
| 23 | CLLSGTYIF | 12 |
| 13 | VRVNTTNCH | 11 |
| 16 | NTTNCHKCL | 11 |
| 17 | TTNCHKCLL | 10 |
| 1 | MTVGFNSDI | 9 |
| 5 | FNSDISSVV | 9 |

TABLE XXXII

109P1D4v.6 N' terminal B4402-9-mers
Each peptide is a portion of SEQ ID NO: 13;
each start position is specified, the length
of peptide is 9 amino acids, and the end position
for each peptide is the start position plus eight

| 16 | NTTNCHKCL | 14 |
|---|---|---|
| 21 | HKCLLSGTY | 12 |
| 23 | CLLSGTYIF | 12 |
| 17 | TTNCHKCLL | 11 |
| 22 | KCLLSGTYI | 11 |
| 1 | MTVGFNSDI | 9 |

TABLE XXXIII

109P1D4v.6 N' terminal-B5101 9-mers
Each peptide is a portion of SEQ ID NO: 13;
each start position is specified, the length
of peptide is 9 amino acids, and the end position
for each peptide is the start position plus eight

| 22 | KCLLSGTYI | 14 |
|---|---|---|
| 1 | MTVGFNSDI | 13 |
| 5 | FNSDISSVV | 13 |
| 7 | SDISSVVRV | 13 |
| 8 | DISSVVRVN | 12 |
| 3 | VGFNSDISS | 10 |
| 4 | GFNSDISSV | 9 |
| 16 | NTTNCHKCL | 8 |
| 17 | TTNCHKCLL | 7 |

TABLE XXXIV

109P1D4v.6 N' terminal-A1 10-mers
Each peptide is a portion of SEQ ID NO: 13;
each start position is specified, the length
of peptide is 10 amino acids, and the end position
for each peptide is the start position plus nine

| 6 | NSDISSVVRV | 15 |
|---|---|---|
| 20 | CHKCLLSGTY | 15 |
| 17 | TTNCHKCLLS | 14 |
| 16 | NTTNCHKCLL | 8 |

TABLE XXXV

109P1D4v.6 N' terminal-A0201 10-mers
Each peptide is a portion of SEQ ID NO: 13;
each start position is specified, the length
of peptide is 10 amino acids, and the end position
for each peptide is the start position plus nine

| 3 | VGFNSDISSV | 18 |
|---|---|---|
| 6 | NSDISSVVRV | 16 |
| 23 | CLLSGTYIFA | 16 |

TABLE XXXV-continued

109P1D4v.6 N' terminal-A0201 10-mers
Each peptide is a portion of SEQ ID NO: 13;
each start position is specified, the length
of peptide is 10 amino acids, and the end position
for each peptide is the start position plus nine

| | | |
|---|---|---|
| 8 | DISSVVRVNT | 13 |
| 9 | ISSVVRVNTT | 13 |
| 16 | NTTNCHKCLL | 13 |
| 4 | GFNSDISSVV | 12 |
| 15 | VNTTNCHKCL | 9 |
| 19 | NCHKCLLSGT | 9 |

TABLE XXXVI

109P1D4v.6 N' terminal-A0203 10-mers
Each peptide is a portion of SEQ ID NO: 13;
each start position is specified, the length
of peptide is 10 amino acids, and the end position
for each peptide is the start position plus nine

| | | |
|---|---|---|
| 23 | CLLSGTYIFA | 10 |

TABLE XXXVII

109P1D4v.6 N' terminal-A3 10-mers
Each peptide is a portion of SEQ ID NO: 13;
each start position is specified, the length
of peptide is 10 amino acids, and the end
position for each peptide is the start
position plus nine

| | | |
|---|---|---|
| 12 | VVRVNTTNCH | 17 |
| 11 | SVVRVNTTNC | 15 |
| 14 | RVNTTNCHKC | 14 |
| 5 | FNSDISSVVR | 13 |
| 8 | DISSVVRVNT | 13 |
| 2 | TVGFNSDISS | 12 |
| 20 | CHKCLLSGTY | 12 |
| 23 | CLLSGTYIFA | 12 |
| 13 | VRVNTTNCHK | 11 |
| 22 | KCLLSGTYIF | 10 |

TABLE XXXVIII

109P1D4v.6 N' terminal-A26 10-mers
Each peptide is a portion of SEQ ID NO: 13;
each start position is specified, the length
of peptide is 10 amino acids, and the end position
for each peptide is the start position plus nine

| | | |
|---|---|---|
| 16 | NTTNCHKCLL | 17 |
| 11 | SVVRVNTTNC | 15 |
| 2 | TVGFNSDISS | 13 |

TABLE XXXVIII-continued

109P1D4v.6 N' terminal-A26 10-mers
Each peptide is a portion of SEQ ID NO: 13;
each start position is specified, the length
of peptide is 10 amino acids, and the end position
for each peptide is the start position plus nine

| | | |
|---|---|---|
| 8 | DISSVVRVNT | 13 |
| 1 | MTVGFNSDIS | 12 |
| 20 | CHKCLLSGTY | 12 |
| 14 | RVNTTNCHKC | 11 |
| 3 | VGFNSDISSV | 10 |
| 7 | SDISSVVRVN | 10 |
| 12 | VVRVNTTNCH | 10 |
| 17 | TTNCHKCLLS | 10 |
| 15 | VNTTNCHKCL | 9 |

TABLE XXXIX

109P1D4v.6
N' terminal-B0702
10-mers
Each peptide is a
portion of SEQ ID NO:
13; each start position
is specified, the length
of peptide is 10 amino
acids, and the end
position for each
peptide is the start
position plus nine

| | | |
|---|---|---|
| 8 | DISSVVRVNT | 11 |
| 6 | NSDISSVVRV | 10 |
| 9 | ISSVVRVNTT | 10 |
| 15 | VNTTNCHKCL | 10 |
| 16 | NTTNCHKCLL | 10 |
| 22 | KCLLSGTYIF | 8 |
| 4 | GFNSDISSVV | 7 |
| 19 | NCHKCLLSGT | 7 |
| 21 | HKCLLSGTYI | 7 |
| 23 | CLLSGTYIFA | 7 |
| 3 | VGFNSDISSV | 6 |

TABLE XL

109P1D4v.6 N' terminal-B08 10-mers

No Results Found.

TABLE XLI

109P1D4v.6 N' terminal B1510-10-mers

No Results Found.

TABLE XLII

109P1D4v.6 N' terminal B2705-10-mers

No Results Found.

TABLE XLIII

109P1D4v.6 N' terminal-B2709 10-mers

No Results Found.

TABLE XLIV

109P1D4 v.6 N' terminal B4402-10-mers
Each peptide is a portion of SEQ ID NO: 13; each start postion is specified, the length of peptide is 10 amino acids, and the end position for each peptide is the start position plus nine

| 22 | KCLLSGTYIF | 14 |
|---|---|---|
| 15 | VNTTNCHKCL | 13 |
| 16 | NTTNCHKCLL | 13 |
| 20 | CHKCLLSGTY | 11 |
| 21 | HKCLLSGTYI | 9 |
| 7 | SDISSVVRVN | 7 |

TABLE XLV

109P1D4v.6 N' terminal B5101-10-mers

No Results Found.

TABLE XLVI

109P1D4v.6 N' terminal-DRB1 0101 15-mers
Each peptide is a portion of SEQ ID NO: 13; each start position is specified, the length of peptide is 15 amino acids, and the end position for each peptide is the start position plus fourteen

| 19 | NCHKCLLSGTYIFAV | 26 |
|---|---|---|
| 2 | TVGFNSDISSVVRVN | 25 |
| 9 | ISSVVRVNTTNCHKC | 22 |
| 10 | SSVVRVNTTNCHKCL | 16 |
| 20 | CHKCLLSGTYIFAVL | 16 |
| 21 | HKCLLSGTYIFAVLL | 16 |
| 22 | KCLLSGTYIFAVLLV | 16 |
| 18 | TNCHKCLLSGTYIFA | 15 |
| 6 | NSDISSVVRVNTTNC | 1 |

TABLE XLVII

109P1D4v.6 N' terminal-DRB1 0301 15-mers
Each peptide is a portion of SEQ ID NO: 13; each start position is specified, the length of peptide is 15 amino acids, and the end position for each peptide is the start position plus fourteen

| 2 | TVGFNSDISSVVRVN | 19 |
|---|---|---|
| 6 | NSDISSVVRVNTTNC | 19 |
| 14 | RVNTTNCHKCLLSGT | 16 |
| 21 | HKCLLSGTYIFAVLL | 13 |
| 9 | ISSVVRVNTTNCHKC | 12 |
| 10 | SSVVRVNTTNCHKCL | 12 |
| 20 | CHKCLLSGTYIFAVL | 12 |
| 12 | VVRVNTTNCHKCLLS | 11 |
| 22 | KCLLSGTYIFAVLLV | 11 |
| 18 | TNCHKCLLSGTYIFA | 10 |

TABLE XLVIII

109P1D4v.6 N' terminal-DRB1 0401 15-mers
Each peptide is a portion of SEQ ID NO: 13; each start position is specified, the length of peptide is 15 amino acids, and the end position for each peptide is the start position plus fourteen

| 2 | TVGFNSDISSVVRVN | 28 |
|---|---|---|
| 6 | NSDISSVVRVNTTNC | 26 |
| 9 | ISSVVRVNTTNCHKC | 20 |
| 10 | SSVVRVNTTNCHKCL | 14 |
| 21 | HKCLLSGTYIFAVLL | 14 |
| 22 | KCLLSGTYIFAVLLV | 14 |

TABLE XLIX

109P1D4v.6
N' terminal-DRB1 1101
15-mers
Each peptide is a portion of SEQ ID NO: 13; each start position is specified, the length of peptide is 15 amino acids, and the end position for each peptide is the start position plus fourteen

| | | |
|---|---|---|
| 6 | NSDISSVVRVNTTNC | 22 |
| 9 | ISSVVRVNTTNCHKC | 12 |
| 21 | HKCLLSGTYIFAVLL | 12 |
| 2 | TVGFNSDISSVVRVN | 11 |
| 14 | RVNTTNCHKCLLSGT | 11 |

TABLE XXII

109P1D4v.7
N' terminal-A1
9-mers
Each peptide is a portion of SEQ ID NO: 15; each start position is specified, the length of peptide is 9 amino acids, and the end position for each peptide is the start position plus eight

| | | |
|---|---|---|
| 13 | SSLSPLLLV | 15 |
| 12 | SSSLSPLLL | 14 |
| 14 | SLSPLLLVS | 14 |
| 1 | MFRVGFLII | 11 |
| 9 | ISSSSSLSP | 10 |
| 11 | SSSSLSPLL | 8 |

TABLE XXIII

109P1D4v.7
N' terminal-A0201
9-mers
Each peptide is a portion of SEQ ID NO: 15; each start position is specified, the length of peptide is 9 amino acids, and the end position for each peptide is the start position plus eight

| | | |
|---|---|---|
| 18 | LLLVSVVRV | 30 |
| 7 | LIISSSSSL | 24 |
| 15 | LSPLLLVSV | 21 |
| 13 | SSLSPLLLV | 20 |
| 14 | SLSPLLLVS | 20 |
| 16 | SPLLLVSVV | 19 |
| 10 | SSSSSLSPL | 16 |

TABLE XXIII-continued

109P1D4v.7
N' terminal-A0201
9-mers
Each peptide is a portion of SEQ ID NO: 15; each start position is specified, the length of peptide is 9 amino acids, and the end position for each peptide is the start position plus eight

| | | |
|---|---|---|
| 19 | LLVSVVRVN | 16 |
| 6 | FLIISSSSS | 15 |

TABLE XXIV

109P1D4v.7 N' terminal-A0203 9-mers

No Results Found.

TABLE XXV

109P1D4v.7
N' terminal-A3
9-mers
Each peptide is a portion of SEQ ID NO: 15; each start position is specified, the length of peptide is 9 amino acids, and the end position for each peptide is the start position plus eight

| | | |
|---|---|---|
| 17 | PLLLVSVVR | 26 |
| 14 | SLSPLLLVS | 21 |
| 6 | FLIISSSSS | 19 |
| 3 | RVGFLIISS | 16 |
| 7 | LIISSSSSL | 16 |
| 18 | LLLVSVVRV | 16 |
| 20 | LVSVVRVNT | 16 |
| 19 | LLVSVVRVN | 15 |
| 8 | IISSSSSLS | 13 |

TABLE XXVI

109P1D4v.7
N' terminal-A26
9-mers
Each peptide is a
portion of SEQ ID
NO: 15; each start
position is specified,
the length of peptide
is 9 amino acids,
and the end position
for each peptide is
the start position
plus eight

| | | |
|---|---|---|
| 7 | LIISSSSSL | 19 |
| 3 | RVGFLIISS | 17 |
| 10 | SSSSSLSPL | 15 |
| 4 | VGFLIISSS | 12 |
| 11 | SSSSLSPLL | 11 |
| 12 | SSSLSPLLL | 10 |
| 20 | LVSVVRVNT | 10 |

TABLE XXVII

109P1D4v.7
N' terminal-B0702
9-mers
Each peptide is a
portion of SEQ ID
NO: 15; each start
position is specified,
the length of peptide
is 9 amino acids,
and the end position
for each peptide is
the start position
plus eight

| | | |
|---|---|---|
| 16 | SPLLLVSVV | 18 |
| 12 | SSSLSPLLL | 14 |
| 10 | SSSSSLSPL | 13 |
| 11 | SSSSLSPLL | 13 |
| 1 | MFRVGFLII | 11 |
| 13 | SSLSPLLLV | 11 |
| 20 | LVSVVRVNT | 11 |
| 7 | LIISSSSSL | 10 |
| 18 | LLLVSVVRV | 9 |

TABLE XXVIII

109P1D4v.7
N' terminal-B08
9-mers
Each peptide is a
portion of SEQ ID
NO: 15; each start
position is specified,
the length of peptide
is 9 amino acids,
and the end position
for each peptide is
the start position
plus eight

| | | |
|---|---|---|
| 7 | LIISSSSSL | 14 |
| 1 | MFRVGFLII | 13 |
| 12 | SSSLSPLLL | 13 |
| 10 | SSSSSLSPL | 12 |
| 11 | SSSSLSPLL | 12 |
| 21 | VSVVRVNTT | 11 |
| 16 | SPLLLVSVV | 10 |
| 18 | LLLVSVVRV | 9 |
| 14 | SLSPLLLVS | 8 |
| 17 | PLLLVSVVR | 8 |
| 6 | FLIISSSSS | 7 |
| 19 | LLVSVVRVN | 7 |

TABLE XXIX

109P1D4v.7
N' terminal-B1510
9-mers
Each peptide is a
portion of SEQ ID
NO: 15; each start
position is specified,
the length of peptide
is 9 amino acids,
and the end position
for each peptide is
the start position
plus eight

| | | |
|---|---|---|
| 11 | SSSSLSPLL | 12 |
| 12 | SSSLSPLLL | 12 |
| 10 | SSSSSLSPL | 11 |
| 7 | LIISSSSSL | 10 |
| 18 | LLLVSVVRV | 6 |

TABLE XXX

109P1D4v.7
N' terminal-B2705
9-mers
Each peptide is a portion of SEQ ID NO: 15; each start position is specified, the length of peptide is 9 amino acids, and the end position for each peptide is the start position plus eight

| | | |
|---|---|---|
| 17 | PLLLVSVVR | 17 |
| 7 | LIISSSSSL | 16 |
| 2 | FRVGFLIIS | 15 |
| 10 | SSSSSLSPL | 13 |
| 11 | SSSSLSPLL | 13 |
| 12 | SSSLSPLLL | 13 |
| 3 | RVGFLIISS | 10 |
| 4 | VGFLIISSS | 10 |
| 1 | MFRVGFLII | 9 |
| 5 | GFLIISSSS | 9 |

TABLE XXXI

109P1D4v.7
N' terminal-B2709
9-mers
Each peptide is a portion of SEQ ID NO: 15; each start position is specified, the length of peptide is 9 amino acids and the end position for each peptide is the start position plus eight

| | | |
|---|---|---|
| 18 | LLLVSVVRV | 13 |
| 7 | LIISSSSSL | 12 |
| 11 | SSSSLSPLL | 12 |
| 13 | SSLSPLLLV | 12 |
| 2 | FRVGFLIIS | 11 |
| 10 | SSSSSLSPL | 11 |
| 12 | SSSLSPLLL | 11 |
| 16 | SPLLVSVV | 11 |
| 1 | MFRVGFLII | 9 |
| 15 | LSPLLLVSV | 9 |

TABLE XXXII

109P1D4v.7
N' terminal-B4402
9-mers
Each peptide is a portion of SEQ ID NO: 15; each start position is specified, the length of peptide is 9 amino acids, and the end position plus eight

| | | |
|---|---|---|
| 12 | SSSLSPLLL | 16 |
| 7 | LIISSSSSL | 13 |
| 10 | SSSSSLSPL | 13 |
| 11 | SSSSLSPLL | 13 |
| 1 | MFRVGFLII | 10 |
| 14 | SLSPLLLVS | 8 |

TABLE XXXIII

109P1D4v.7
N' terminal-B5101
9-mers
Each peptide is a portion of SEQ ID NO: 15; each start position is specified the length of peptide is 9 amino acids, and the end position for each peptide is the start position plus eight

| | | |
|---|---|---|
| 16 | SPLLLVSVV | 25 |
| 18 | LLLVSVVRV | 17 |
| 1 | MFRVGFKII | 13 |
| 15 | LSPLLLVSV | 13 |

TABLE XXXIV

109P104v.7
N' terminal-A1
10-mers
Each peptide is a portion of SEQ ID NO: 15; each start position is specified, the length of peptide is 10 amino acids, and the end position for each peptide is the start position plus nine

| | | |
|---|---|---|
| 11 | SSSSLSPLLL | 14 |
| 12 | SSSLSPLLLV | 14 |
| 13 | SSLSPLLLVS | 13 |
| 10 | SSSSSLSPLL | 8 |
| 14 | SLSPLLLVSV | 7 |

TABLE XXXV

109P1D4v.7
N' terminal
A0201-10-mers
Each peptide is a
portion of SEQ ID
NO: 15; each start
position is specified,
the length of peptide
is 10 amino acids,
and the end position
for each peptide is the
start position plus
nine

| | | |
|---|---|---|
| 14 | SLSPLLLVSV | 32 |
| 6 | FLIISSSSSL | 25 |
| 17 | PLLLVSVVRV | 25 |
| 18 | LLLVSVVRVN | 18 |
| 19 | LLVSVVRVNT | 18 |
| 12 | SSSLSPLLLV | 17 |
| 20 | LVSVVRVNTT | 17 |
| 9 | ISSSSSLSPL | 16 |
| 15 | LSPLLLVSVV | 16 |

TABLE XXXVI

109P1D4v.7 N' terminal A0203-10-mers

No Results Found.

TABLE XXXVII

109P1D4V.7
N' terminal-A3
10-mers
Each peptide is a
portion of SEQ ID
NO: 15; each start
position is specified,
the length of peptide
is 10 amino acids,
and the end position
for each peptide is the
start position plus
nine

| | | |
|---|---|---|
| 14 | SLSPLLLVSV | 20 |
| 3 | RVGFLIISSS | 19 |
| 6 | FLIISSSSSL | 19 |
| 17 | PLLLVSVVRV | 17 |
| 16 | SPLLLVSVVR | 16 |
| 18 | LLLVSVVRVN | 16 |
| 8 | IISSSSSLSP | 15 |
| 19 | LLVSVVRVNT | 15 |
| 7 | LIISSSSSLS | 14 |
| 20 | LVSVVRVNTT | 14 |
| 13 | SSLSPLLLVS | 10 |

TABLE XXXVIII

109P1D4v.7 N' terminal A26-10-mers
Each peptide is a portion of SEQ ID NO: 15;
each start position is specified, the length of
peptide is 10 amino acids, and the end position
for each peptide is the start position plus nine

| | | |
|---|---|---|
| 3 | RVGFLIISSS | 16 |
| 20 | LVSVVRVNTT | 15 |
| 6 | FLIISSSSSL | 14 |
| 9 | ISSSSSLSPL | 14 |
| 11 | SSSSLSPLLL | 11 |
| 2 | FRVGFLIISS | 10 |
| 7 | LIISSSSSLS | 10 |
| 10 | SSSSSLSPLL | 10 |

TABLE XXXIX

109P1D4v.7 N' terminal-B0702 10-mers
Each peptide is a portion of SEQ ID NO: 15;
each start position is specified, the length of
peptide is 10 amino acids, and the end position
for each peptide is the start position plus nine

| | | |
|---|---|---|
| 9 | ISSSSSLSPL | 14 |
| 11 | SSSSLSPLLL | 14 |
| 10 | SSSSSLSPLL | 13 |
| 16 | SPLLLVSVVR | 13 |
| 14 | SLSPLLLVSV | 11 |
| 6 | FLIISSSSSL | 10 |
| 12 | SSSLSPLLLV | 10 |
| 17 | PLLLVSVVRV | 9 |
| 19 | LLVSVVRVNT | 9 |
| 20 | LVSVVRVNTT | 9 |
| 15 | LSPLLLVSVV | 8 |

TABLE XL

109P1D4v.7 N' terminal-B08 10-mers

No Results Found.

TABLE XLI

109P1D4v.7 N' terminal-B1510 10-mers

No Results Found.

TABLE XLII

109P1D4v.7 N' terminal-B2705 10-mers

No Results Found.

TABLE XLIII

109P1D4v.7 N' terminal-B2709 10-mers

No Results Found.

TABLE XLIV

109P1D4v.7 N' terminal-B4402 10-mers
Each peptide is a portion of SEQ ID NO: 15;
each start position is specified, the length of
peptide is 10 amino acids, and the end position
for each peptide is the start position plus nine

| | | |
|---|---|---|
| 11 | SSSSLSPLLL | 15 |
| 6  | FLIISSSSSL | 13 |
| 10 | SSSSSLSPLL | 13 |
| 9  | ISSSSSLSPL | 12 |

TABLE XLV

109P1D4v.7 N' terminal-B5101 10-mers

No Results Found.

TABLE XLVI

109P1D4v.7 N' terminal-DRB1 0101 15-mers
Each peptide is a portion of SEQ ID NO: 15; each
start position is specified, the length of peptide
is 15 amino acids, and the end position for
each peptide is the start position plus fourteen

| | | |
|---|---|---|
| 3  | RVGFLIISSSSSLSP | 33 |
| 1  | MFRVGFLIISSSSSL | 25 |
| 4  | VGFLIISSSSSLSPL | 25 |
| 12 | SSSLSPLLLVSVVRV | 24 |
| 15 | LSPLLLVSVVRVNTT | 23 |
| 5  | GFLIISSSSSLSPLL | 22 |
| 6  | FLIISSSSSLSPLLL | 22 |
| 9  | ISSSSSLSPLLLVSV | 22 |
| 20 | LVSVVRVNTTNCHKC | 22 |
| 2  | FRVGFLIISSSSSLS | 21 |
| 13 | SSLSPLLLVSVVRVN | 17 |

TABLE XLVII

109P1D4v.7 N' terminal-DRB1 0301 15-mers
Each peptide is a portion of SEQ ID NO: 15; each
start position is specified, the length of peptide
is 15 amino acids, and the end position for
each peptide is the start position plus fourteen

| | | |
|---|---|---|
| 4  | VGFLIISSSSSLSPL | 20 |
| 17 | PLLLVSVVRVNTTNC | 20 |
| 15 | LSPLLLVSVVRVNTT | 15 |
| 5  | GFLIISSSSSLSPLL | 14 |

TABLE XLVII-continued

109P1D4v.7 N' terminal-DRB1 0301 15-mers
Each peptide is a portion of SEQ ID NO: 15; each
start position is specified, the length of peptide
is 15 amino acids, and the end position for
each peptide is the start position plus fourteen

| | | |
|---|---|---|
| 6  | FLIISSSSSLSPLLL | 13 |
| 12 | SSSLSPLLLVSVVRV | 13 |
| 9  | ISSSSSLSPLLLVSV | 12 |
| 16 | SPLLLVSVVRVNTTN | 12 |
| 20 | LVSVVRVNTTNCHKC | 12 |
| 21 | VSVVRVNTTNCHKCL | 12 |
| 3  | RVGFLIISSSSSLSP | 11 |
| 8  | IISSSSSLSPLLLVS | 11 |
| 18 | LLLVSVVRVNTTNCH | 11 |
| 1  | MFRVGFLIISSSSSL | 10 |
| 7  | LIISSSSSLSPLLLV | 10 |

TABLE XLVIII

109P1D4v.7 N' terminal-DRB1 0401 15-mers
Each peptide is a portion of SEQ ID NO: 15; each
start position is specified, the length of peptide
is 15 amino acids, and the end position for
each peptide is the start position plus fourteen

| | | |
|---|---|---|
| 3  | RVGFLIISSSSSLSP | 28 |
| 17 | PLLLVSVVRVNTTNC | 26 |
| 1  | MFRVGFLIISSSSSL | 20 |
| 4  | VGFLIISSSSSLSPL | 20 |
| 5  | GFLIISSSSSLSPLL | 20 |
| 12 | SSSLSPLLLVSVVRV | 20 |
| 15 | LSPLLLVSVVRVNTT | 20 |
| 18 | LLLVSVVRVNTTNCH | 20 |
| 20 | LVSVVRVNTTNCHKC | 20 |
| 2  | FRVGFLIISSSSSLS | 18 |
| 6  | FLIISSSSSLSPLLL | 14 |
| 16 | SPLLLVSVVRVNTTN | 14 |
| 21 | VSVVRVNTTNCHKCL | 14 |

TABLE XLIX

109P1D4v.7 N' terminal-DRB1 1101 15-mers
Each peptide is a portion of SEQ ID NO: 15; each
start position is specified, the length of peptide
is 15 amino acids, and the end position for
each peptide is the start position plus fourteen

| | | |
|---|---|---|
| 3  | RVGFLIISSSSSLSP | 22 |
| 17 | PLLLVSVVRVNTTNC | 22 |

TABLE XLIX-continued

109P1D4v.7 N' terminal-DRB1 1101 15-mers
Each peptide is a portion of SEQ ID NO: 15; each start position is specified, the length of peptide is 15 amino acids, and the end position for each peptide is the start position plus fourteen

| 1 | MFRVGFLIISSSSSL | 18 |
|---|---|---|
| 15 | LSPLLLVSVVRVNTT | 14 |
| 2 | FRVGFLIISSSSSLS | 13 |
| 5 | GFLIISSSSSLSPLL | 13 |
| 18 | LLLVSVVRVNTTNCH | 13 |
| 6 | FLIISSSSSLSPLLL | 12 |
| 12 | SSSLSPLLLVSVVRV | 12 |
| 20 | LVSVVRVNTTNCHKC | 12 |
| 16 | SPLLLVSVVRVNTTN | 11 |

TABLE XXII

109P1D4v.8-A1 9-mers
Each peptide is a portion of SEQ ID NO: 17; each start position is specified, the length of peptide is 9 amino acids, and the end position for each peptide is the start position plus eight

| 7 | KKEITVQPT | 11 |
|---|---|---|
| 1 | TFIPGLKKE | 8 |

TABLE XXIII

109P1D4v.8 A0201-9-mers
Each peptide is a portion of SEQ ID NO: 17; each start position is specified, the length of peptide is 9 amino acids, and the end position for each peptide is the start position plus eight

| 2 | FIPGLKKEI | 21 |
|---|---|---|
| 8 | KEITVQPTV | 16 |
| 5 | GLKKEITVQ | 14 |
| 4 | PGLKKEITV | 12 |

TABLE XXIV

109P1D4v.8 A0203-9-mers

No Results Found

TABLE XXV

109P1D4v.8 A3-9-mers
Each peptide is a portion of SEQ ID NO: 17; each start position is specified, the length of peptide is 9 amino acids, and the end position for each peptide is the start position plus eight

| 5 | GLKKEITVQ | 16 |
|---|---|---|
| 8 | KEITVQPTV | 11 |
| 2 | FIPGLKKEI | 10 |

TABLE XXV-continued

109P1D4v.8 A3-9-mers
Each peptide is a portion of SEQ ID NO: 17; each start position is specified, the length of peptide is 9 amino acids, and the end position for each peptide is the start position plus eight

| 6 | LKKEITVQP | 9 |
|---|---|---|
| 1 | TFIPGLKKE | 8 |

TABLE XXVI

109P1D4v.8 A26-9-mers
Each peptide is a portion of SEQ ID NO: 17; each start position is specified, the length of peptide is 9 amino acids, and the end position for each peptide is the start position plus eight

| 1 | TFIPGLKKE | 11 |
|---|---|---|
| 2 | FIPGLKKEI | 5 |
| 6 | LKKEITVQP | 5 |
| 8 | KEITVQPTV | 5 |

TABLE XXVII

109P1D4v.8 B0702-9-mers
Each peptide is a portion of SEQ ID NO: 17; each start position is specified, the length of peptide is 9 amino acids, and the end position for each peptide is the start position plus eight

| 3 | IPGLKKEIT | 18 |
|---|---|---|
| 7 | KKEITVQPT | 9 |

TABLE XXVIII

109P1D4v.8 B08-9-mers
Each peptide is a portion of SEQ ID NO: 17; each start position is specified, the length of peptide is 9 amino acids, and the end position for each peptide is the start position plus eight

| 3 | IPGLKKEIT | 18 |
|---|---|---|
| 5 | GLKKEITVQ | 18 |
| 2 | FIPGLKKEI | 13 |
| 6 | LKKEITVQP | 13 |
| 4 | PGLKKEITV | 10 |

TABLE XXIX

109P1D4v.8 B1510-9-mers
Each peptide is a portion of SEQ ID NO: 17; each start position is specified, the length of peptide is 9 amino acids, and the end position for each peptide is the start position plus eight

| 5 | GLKKEITVQ | 5 |
|---|---|---|
| 1 | TFIPGLKKE | 4 |
| 2 | FIPGLKKEI | 3 |

TABLE XXIX-continued

109P1D4v.8 B1510-9-mers
Each peptide is a portion of SEQ ID NO: 17;
each start position is specified, the length
of peptide is 9 amino acids, and the end position
for each peptide is the start position plus eight

| | | |
|---|---|---|
| 3 | IPGLKKEIT | 3 |
| 6 | LKKEITVQP | 3 |

TABLE XXX

109P1D4v.8 B2705-9-mers
Each peptide is a portion of SEQ ID NO: 17;
each start position is specified, the length
of peptide is 9 amino acids, and the end position
for each peptide is the start position plus eight

| | | |
|---|---|---|
| 5 | GLKKEITVQ | 12 |
| 2 | FIPGLKKEI | 11 |
| 8 | KEITVQPTV | 9 |
| 1 | TFIPGLKKE | 8 |
| 4 | PGLKKEITV | 7 |

TABLE XXXI

109P1D4v.8 B2709-9-mers
Each peptide is a portion of SEQ ID NO: 17;
each start position is specified, the length
of peptide is 9 amino acids, and the end position
for each peptide is the start position plus eight

| | | |
|---|---|---|
| 8 | KEITVQPTV | 12 |
| 4 | PGLKKEITV | 10 |
| 2 | FIPGLKKEI | 8 |

TABLE XXXII

109P1D4v.8 B4402-9-mers
Each peptide is a portion of SEQ ID NO: 17;
each start position is specified, the length
of peptide is 9 amino acids, and the end position
for each peptide is the start position plus eight

| | | |
|---|---|---|
| 8 | KEITVQPTV | 16 |
| 2 | FIPGLKKEI | 12 |
| 1 | TFIPGLKKE | 10 |

TABLE XXXIII

109P1D4v.8 B5101-9-mers
Each peptide is a portion of SEQ ID NO: 17;
each start position is specified, the length
of peptide is 9 amino acids, and the end position
for each peptide is the start position plus eight

| | | |
|---|---|---|
| 4 | PGLKKEITV | 21 |
| 2 | FIPGLKKEI | 14 |
| 3 | IPGLKKEIT | 13 |
| 8 | KEITVQPTV | 13 |

TABLE XXXIV

109P1D4v.8 A1-10-mers
Each peptide is a portion of SEQ ID NO: 17;
each start position is specified, the length
of peptide is 10 amino acids, and the end position
for each peptide is the start position plus nine

| | | |
|---|---|---|
| 1 | STFIPGLKKE | 10 |
| 8 | KKEITVQPTV | 10 |

TABLE XXXV

109P1D4v.8 A0201-10-mers
Each peptide is a portion of SEQ ID NO: 17;
each start position is specified, the length
of peptide is 10 amino acids, and the end position
for each peptide is the start position plus nine

| | | |
|---|---|---|
| 3 | FIPGLKKEIT | 15 |
| 4 | IPGLKKEITV | 14 |
| 2 | TFIPGLKKEI | 13 |
| 8 | KKEITVQPTV | 13 |
| 1 | STFIPGLKKE | 12 |
| 6 | GLKKEITVQP | 12 |
| 7 | LKKEITVQPT | 11 |

TABLE XLVI

109P1D4v.8
ORB1 0101-15-mers
Each peptide is a portion of
SEQ ID NO: 17, each start
position is specified, the
length of peptide is 15 amino
acids, and the end position
for each peptide is the start
position plus fourteen

| | | |
|---|---|---|
| 9 | IPGLKKEITVQPTVE | 25 |
| 13 | KKEITVQPTVEEASD | 21 |
| 5 | ESTFIPGLKKEITVQ | 19 |
| 3 | DPESTFIPGLKKEIT | 17 |
| 6 | STFIPGLKKEITVQP | 16 |
| 12 | LKKEITVQPTVEEAS | 13 |

TABLE XXXVI

109P1D4v.8 A0203-10-mers

No Results Found.

TABLE XXXVII

109P1D4v.8
A3-10-mers
Each peptide is a portion of SEQ ID NO: 17; each start position is specified, the length of peptide is 10 amino acids, and the end position for each peptide is the start position plus nine

| 6 | GLKKEITVQP | 18 |
|---|---|---|
| 9 | KEITVQPTVE | 12 |
| 3 | FIPGLKKEIT | 10 |

TABLE XXXVIII

109P1D4v.8
A0201-10-mers
Each peptide is a portion of SEQ ID NO: 17; each start position is specified, the length of peptide is 10 amino acids, and the end position for each peptide is the start position plus nine

| 1 | STFIPGLKKE | 18 |
|---|---|---|

TABLE XXXIX

109P1D4v.8
B0702-10-mers
Each peptide is a portion of SEQ ID NO: 17; each start position is specified, the length of peptide is 10 amino acids, and the end position for each peptide is the start position plus nine

| 4 | IPGLKKEITV | 18 |
|---|---|---|
| 3 | FIPGLKKEIT | 8 |
| 7 | LKKEITVQPT | 8 |
| 8 | KKEITVQPTV | 8 |

TABLE XL

109P1D4v.8 B08-10-mers

No Results Found.

TABLE XLI

109P1D4v.8 B1510-10-mers

No Results Found.

TABLE XLII

109P1D4v.8 B2705-10-mers

No Results Found.

TABLE XLIII

109P1D4v.8 B2709-10-mers

No Results Found.

TABLE XLIV

109P1D4v.8
B4402-10-mers
Each peptide is a portion of SEQ ID NO: 17; each start position is specified, the length of peptide is 10 amino acids, and the end position for each peptide is the start position plus nine

| 9 | KEITVQPTVE | 17 |
|---|---|---|
| 2 | TFIPGLKKEI | 16 |

TABLE XLV

109P1D4v.8 B5101-10-mers

No Results Found.

TABLE XLVII

109P1D4v.8
DRB1 0301-15-mers
Each peptide is a portion of SEQ ID NO: 17; each start position is specified, the length of peptide is 15 amino acids, and the end position for each peptide is the start position plus fourteen

| 5 | ESTFIPGLKKEITVQ | 17 |
|---|---|---|
| 6 | STFIPGLKKEITVQP | 17 |
| 13 | KKEITVQPTVEEASD | 13 |
| 9 | IPGLKKEITVQPTVE | 12 |
| 1 | NSDPESTFIPGLKKE | 9 |

TABLE XLVIII

109P1D4v.8
DRB1 0401-15-mers
Each peptide is a portion of SEQ ID NO: 17; each start position is specified, the length of peptide is 15 amino acids, and the end position for each peptide is the start position plus fourteen

| | | |
|---|---|---|
| 6 | STFIPGLKKEITVQP | 20 |
| 9 | IPGLKKEITVQPTVE | 20 |
| 5 | ESTFIPGLKKEITVQ | 16 |
| 13 | KKEITVQPTVEEASD | 14 |
| 2 | SDPESTFIPGLKKEI | 12 |
| 3 | DPESTFIPGLKKEIT | 12 |
| 10 | PGLKKEITVQPTVEE | 12 |
| 11 | GLKKEITVQPTVEEA | 12 |

TABLE XLIX

109P1D4v.8
DRB1 1101-15-mers
Each peptide is a portion of SEQ ID NO: 17; each start position is specified, the length of peptide is 15 amino acids, and the end position for each peptide is the start position plus fourteen

| | | |
|---|---|---|
| 6 | STFIPGLKKEITVQP | 21 |
| 5 | ESTFIPGLKKEITVQ | 18 |
| 9 | IPGLKKEITVQPTVE | 12 |

TABLE L

Protein Characteristics of 109P1D4

| 109P1D4 var.1 | Bioinformatic Program | URL on World Wide Web | Outcome |
|---|---|---|---|
| ORF | ORF finder | | 846-3911 bp (includes stop codon) |
| Protein length | | | 1021aa |
| Transmembrane region | TM Pred | .ch.embnet.org/ | 3 TM helices (aa3-aa23, aa756-776, aa816-aa834), N terminus intracellular |
| | HMMTop | .enzim.hu/hmmtop/ | no TM, N terminus extracellular |
| | Sosui | .genome.ad.jp/SOSui/ | 3 TM helices (2-24aa, 756-778aa, 810-832aa), N terminus extracellular |
| | TMHMM | .cbs.dtu.dk/services/TMHMM | 1 TM helix (813-835aa), N terminus extracellular |
| Signal Peptide | Signal P | .cbs.dtu.dk/services/SignalP/ | yes |
| pI | pI/MW tool | .expasy.ch/tools/ | pI 4.81 |
| Molecular weight | pI/MW tool | .expasy.ch/tools/ | 112.7 kDa |
| Localization | PSORT | psort.nibb.ac.jp/ | Plasma membrane |
| | PSORT II | psort.nibb.ac.jp/ | 67% endoplasmic reticulum |
| Motifs | Pfam | .sanger.ac.uk/Pfam/ | Cadherin domain |
| | Prints | .biochem.ucl.ac.uk/ | Cadherin domain, DNA topoiso-Merase 4B, sonic hedgehog |
| | Blocks | .blocks.fhcrc.org/ | Cadherin domain, ribosomal protein L10E, ribulose biphosphate carboxylase (large chain), ornithine decarboxylase antizyme protein phosphatase 2C subfamily |

TABLE LI

Exon boundaries of transcript 109P1D4 v.1

| Exon | Start | End | Length |
|---|---|---|---|
| 1 | 1 | 1385 | 1385 |
| 2 | 1386 | 4603 | 3218 |

TABLE LII(a)

Nucleotide sequence of transcript variant 109P1D4 v.2 (SEQ ID NO: 237)

```
cccctttctc cccctcggtt aagtccctcc ccctcgccat tcaaaagggc tggctcggca      60
ctggctcctt gcagtcggcg aactgtcggg gcgggaggag ccgtgagcag tagctgcact     120
cagctgcccg cgcggcaaag aggaaggcaa gccaaacaga gtgcgcagag tggcagtgcc     180
agcggcgaca caggcagcac aggcagcccg ggctgcctga atagcctcag aaacaacctc     240
agcgactccg gctgctctgc ggactgcgag ctgtggcggt agagcccgct acagcagtcg     300
cagtctccgt ggagcgggcg gaagcctttt ttctcccttt cgtttacctc ttcattctac     360
tctaaaggca tcgttattag gaaaatcctg ttgcgaataa gaaggattcc acagatcaca     420
taccggagag gttttgcctc agctgctctc aactttgtaa tcttgtgaag aagctgacaa     480
gcttggctga ttgcagagca ctatgaggac tgaacgacag tgggttttaa ttcagatatt     540
tcaagtgttg tgcgggttaa tacaacaaac tgtaacaagt gtacctggta tggacttgtt     600
gtccgggacg tacattttcg cggtcctgct agcatgcgtg gtgttccact ctggcgccca     660
ggagaaaaac tacaccatcc gagaagaaat gccagaaaac gtcctgatag gcgacttgtt     720
gaaagacctt aacttgtcgc tgattccaaa caagtccttg acaactgcta tgcagttcaa     780
gctagtgtac aagaccggag atgtgccact gattcgaatt gaagaggata ctggtgagat     840
cttcactact ggcgctcgca ttgatcgtga gaaattatgt gctggtatcc aagggatga      900
gcattgcttt tatgaagtgg aggttgccat tttgccggat gaaatattta gactggttaa     960
gatacgtttt ctgatagaag atataaatga taatgcacca ttgttcccag caacagttat    1020
caacatatca attccagaga actcggctat aaactctaaa tatactctcc cagcggctgt    1080
tgatcctgac gtaggaataa acggagttca aaactacgaa ctaattaaga gtcaaaacat    1140
ttttggcctc gatgtcattg aaacaccaga aggagacaag atgccacaac tgattgttca    1200
aaaggagtta gatagggaag agaaggatac ctacgtgatg aaagtaaagg ttgaagatgg    1260
tggctttcct caaagatcca gtactgctat tttgcaagtg agtgttactg atacaaatga    1320
caaccaccca gtctttaagg agacagagat tgaagtcagt ataccagaaa atgctcctgt    1380
aggcacttca gtgacacagc tccatgccac agatgctgac ataggtgaaa atgccaagat    1440
ccacttctct ttcagcaatc tagtctccaa cattgccagg agattatttc acctcaatgc    1500
caccactgga cttatcacaa tcaaagaacc actggatagg gaagaaacac caaaccacaa    1560
gttactggtt ttggcaagtg atggtggatt gatgccagca agagcaatgg tgctggtaaa    1620
tgttacagat gtcaatgata atgtcccatc cattgacata agatacatcg tcaatcctgt    1680
caatgacaca gttgttcttt cagaaaatat tccactcaac accaaaattg ctctcataac    1740
tgtgacggat aaggatgcgg accataatgg caggtgaca tgcttcacag atcatgaaat     1800
cccctttcaga ttaaggccag tattcagtaa tcagttcctc ctggagactg cagcatatct    1860
tgactatgag tccacaaaag aatatgccat taaattactg gctgcagatg ctggcaaacc    1920
tcctttgaat cagtcagcaa tgctcttcat caaagtgaaa gatgaaaatg acaatgctcc    1980
agttttcacc cagtctttcg taactgtttc tattcctgag aataactctc ctggcatcca    2040
gttgacgaaa gtaagtgcaa tggatgcaga cagtgggcct aatgctaaga tcaattacct    2100
gctaggccct gatgctccac ctgaattcag cctggattgt cgtacaggca tgctgactgt    2160
agtgaagaaa ctagatagag aaaaagagga taaatattta ttcacaattc tggcaaaaga    2220
taacgggta ccaccccttaa ccagcaatgt cacagtcttt gtaagcatta ttgatcagaa    2280
tgacaatagc ccagttttca ctcacaatga atacaacttc tatgtcccag aaaaccttcc    2340
```

TABLE LII(a)-continued

Nucleotide sequence of transcript variant 109P1D4 v.2 (SEQ ID NO: 237)

```
aaggcatggt acagtaggac taatcactgt aactgatcct gattatggag acaattctgc   2400
agttacgctc tccattttag atgagaatga tgacttcacc attgattcac aaactggtgt   2460
catccgacca aatatttcat ttgatagaga aaaacaagaa tcttacactt tctatgtaaa   2520
ggctgaggat ggtggtagag tatcacgttc ttcaagtgcc aaagtaacca taaatgtggt   2580
tgatgtcaat gacaacaaac cagttttcat tgtccctcct tccaactgtt cttatgaatt   2640
ggttctaccg tccactaatc caggcacagt ggtctttcag gtaattgctg ttgacaatga   2700
cactggcatg aatgcagagg ttcgttacag cattgtagga ggaaacacaa gagatctgtt   2760
tgcaatcgac caagaaacag gcaacataac attgatggag aaatgtgatg ttacagacct   2820
tggtttacac agagtgttgg tcaaagctaa tgacttagga cagcctgatt ctctcttcag   2880
tgttgtaatt gtcaatctgt tcgtgaatga gtcggtgacc aatgctacac tgattaatga   2940
actggtgcgc aaaagcactg aagcaccagt gaccccaaat actgagatag ctgatgtatc   3000
ctcaccaact agtgactatg tcaagatcct ggttgcagct gttgctggca ccataactgt   3060
cgttgtagtt attttcatca ctgctgtagt aagatgtcgc caggcaccac accttaaggc   3120
tgctcagaaa acaagcaga attctgaatg ggctacccca aacccagaaa acaggcagat   3180
gataatgatg aagaaaaaga aaaagaagaa gaagcattcc cctaagaact tgctgcttaa   3240
ttttgtcact attgaagaaa ctaaggcaga tgatgttgac agtgatggaa acagagtcac   3300
actagacctt cctattgatc tagaagagca aacaatggga aagtacaatt gggtaactac   3360
acctactact ttcaagcccg acagccctga tttggcccga cactacaaat ctgcctctcc   3420
acagcctgcc ttccaaattc agcctgaaac tccctgaat tcgaagcacc acatcatcca   3480
agaactgcct ctcgataaca cctttgtggc ctgtgactct atctccaagt gttcctcaag   3540
cagttcagat ccctacagcg tttctgactg tggctatcca gtgacgacct tcgaggtacc   3600
tgtgtccgta cacaccagac cgactgattc caggacatca actattgaaa tctgcagtga   3660
gatataactt tctaggaaca acaaaattcc attcccttc caaaaaattt caatgattgt   3720
gatttcaaaa ttaggctaag atcattaatt ttgtaatcta gatttcccat tataaaagca   3780
agcaaaaatc atcttaaaaa tgatgtccta gtgaaccttg tgctttcttt agctgtaatc   3840
tggcaatgga aatttaaaat ttatggaaga gacagtgcag cacaataaca gagtactctc   3900
atgctgtttc tctgtttgct ctgaatcaac agccatgatg taatataagg ctgtcttggt   3960
gtatacactt atggttaata tatcagtcat gaaacatgca attacttgcc ctgtctgatt   4020
gttgaataat taaacatta tctccaggag tttggaagtg agctgaacta gccaaactac   4080
tctctgaaag gtatccaggg caagagacat ttttaagacc ccaaacaaac aaaaaacaaa   4140
accaaaacac tctggttcag tgttttgaaa atattcacta acataatatt gctgagaaaa   4200
tcatttttat tacccaccac tctgcttaaa agttgagtgg gccgggcgcg gtggctcacg   4260
cctgtaatcc cagcactttg ggaggccgag gcgggtggat cacgaggtca ggagattgag   4320
accatcctgg ctaacacggt gaaacccat ctccactaaa aatacaaaaa attagccgg   4380
cgtggtggcg ggcgcctgta gtcccagcta ctcgggaggc tgaggcagga gaatagcgtg   4440
aacccgggag gcggagcttg cagtgagccg agatggcgcc actgcactcc agcctgggtg   4500
acagagcaag actctgtctc aaaaagaaaa aaatgttcaa tgatagaaaa taatttttact   4560
aggttttttat gttgattgta ctcatgctgt tccactcctt ttaattatta aaaagttatt   4620
```

TABLE LII(a)-continued

Nucleotide sequence of transcript variant 109P1D4 v.2 (SEQ ID NO: 237)

```
tttggctggg tgtggtggct cacacctgta atcccagcac tttgggaggc cgaggtgggt    4680
ggatcacctg aggtcaggag ttcaagacca gtctggccaa cat                      4723
```

TABLE LIII(a)

Nucleotide sequence alignment of 109P1D4 v.1 (SEQ ID NO: 238) and 109P1D4 v.2 (SEQ ID NO: 239) Score = 5920 bits (3079), Expect = 0.0 Identities = 3079/3079 (100%) Strand = Plus/Plus

```
V.1:    800  agtgttgtgcgggttaatacaacaaactgtaacaagtgtacctggtatggacttgttgtc   859
             ||||||||||||||||||||||||||||||||||||||||||||||||||||||||||||
V.2:    544  agtgttgtgcgggttaatacaacaaactgtaacaagtgtacctggtatggacttgttgtc   603

V.1:    860  cgggacgtacattttcgcggtcctgctagcatgcgtggtgttccactctggcgcccagga   919
             ||||||||||||||||||||||||||||||||||||||||||||||||||||||||||||
V.2:    604  cgggacgtacattttcgcggtcctgctagcatgcgtggtgttccactctggcgcccagga   663

V.1:    920  gaaaaactacaccatccgagaagaaatgccagaaaacgtcctgataggcgacttgttgaa   979
             ||||||||||||||||||||||||||||||||||||||||||||||||||||||||||||
V.2:    664  gaaaaactacaccatccgagaagaaatgccagaaaacgtcctgataggcgacttgttgaa   723

V.1:    980  agaccttaacttgtcgctgattccaaacaagtccttgacaactgctatgcagttcaagct  1039
             ||||||||||||||||||||||||||||||||||||||||||||||||||||||||||||
V.2:    724  agaccttaacttgtcgctgattccaaacaagtccttgacaactgctatgcagttcaagct   783

V.1:   1040  agtgtacaagaccggagatgtgccactgattcgaattgaagaggatactggtgagatctt  1099
             ||||||||||||||||||||||||||||||||||||||||||||||||||||||||||||
V.2:    784  agtgtacaagaccggagatgtgccactgattcgaattgaagaggatactggtgagatctt   843

V.1:   1100  cactactggcgctcgcattgatcgtgagaaattatgtgctggtatcccaagggatgagca  1159
             ||||||||||||||||||||||||||||||||||||||||||||||||||||||||||||
V.2:    844  cactactggcgctcgcattgatcgtgagaaattatgtgctggtatcccaagggatgagca   903

V.1:   1160  ttgcttttatgaagtggaggttgccattttgccggatgaaatatttagactggttaagat  1219
             ||||||||||||||||||||||||||||||||||||||||||||||||||||||||||||
V.2:    904  ttgcttttatgaagtggaggttgccattttgccggatgaaatatttagactggttaagat   963

V.1:   1220  acgtttctgatagaagatataaatgataatgcaccattgttcccagcaacagttatcaa  1279
             ||||||||||||||||||||||||||||||||||||||||||||||||||||||||||||
V.2:    964  acgtttctgatagaagatataaatgataatgcaccattgttcccagcaacagttatcaa  1023

V.1:   1280  catatcaattccagagaactcggctataaactctaaatatactctcccagcggctgttga  1339
             ||||||||||||||||||||||||||||||||||||||||||||||||||||||||||||
V.2:   1024  catatcaattccagagaactcggctataaactctaaatatactctcccagcggctgttga  1083

V.1:   1340  tcctgacgtaggaataaacggagttcaaaactacgaactaattaagagtcaaaacatttt  1399
             ||||||||||||||||||||||||||||||||||||||||||||||||||||||||||||
V.2:   1084  tcctgacgtaggaataaacggagttcaaaactacgaactaattaagagtcaaaacatttt  1143

V.1:   1400  tggcctcgatgtcattgaaacaccagaaggagacaagatgccacaactgattgttcaaaa  1459
             ||||||||||||||||||||||||||||||||||||||||||||||||||||||||||||
V.2:   1144  tggcctcgatgtcattgaaacaccagaaggagacaagatgccacaactgattgttcaaaa  1203

V.1:   1460  ggagttagatagggaagagaaggatacctacgtgatgaaagtaaaggttgaagatggtgg  1519
             ||||||||||||||||||||||||||||||||||||||||||||||||||||||||||||
V.2:   1204  ggagttagatagggaagagaaggatacctacgtgatgaaagtaaaggttgaagatggtgg  1263

V.1:   1520  ctttcctcaaagatccagtactgctattttgcaagtgagtgttactgatacaaatgacaa  1579
             ||||||||||||||||||||||||||||||||||||||||||||||||||||||||||||
V.2:   1264  ctttcctcaaagatccagtactgctattttgcaagtgagtgttactgatacaaatgacaa  1323

V.1:   1580  ccacccagtctttaaggagacagagattgaagtcagtataccagaaaatgctcctgtagg  1639
             ||||||||||||||||||||||||||||||||||||||||||||||||||||||||||||
V.2:   1324  ccacccagtctttaaggagacagagattgaagtcagtataccagaaaatgctcctgtagg  1383

V.1:   1640  cacttcagtgacacagctccatgccacagatgctgacataggtgaaaatgccaagatcca  1699
             ||||||||||||||||||||||||||||||||||||||||||||||||||||||||||||
V.2:   1384  cacttcagtgacacagctccatgccacagatgctgacataggtgaaaatgccaagatcca  1443

V.1:   1700  cttctctttcagcaatctagtctccaacattgccaggagattatttcacctcaatgccac  1759
             ||||||||||||||||||||||||||||||||||||||||||||||||||||||||||||
V.2:   1444  cttctctttcagcaatctagtctccaacattgccaggagattatttcacctcaatgccac  1503
```

TABLE LIII(a) -continued

Nucleotide sequence alignment of 109P1D4 v.1 (SEQ ID NO: 238) and
109P1D4 v.2 (SEQ ID NO: 239) Score = 5920 bits (3079),
Expect = 0.0 Identities = 3079/3079 (100%) Strand = Plus/Plus

```
V.1:  1760  cactggacttatcacaatcaaagaaccactggatagggaagaaacaccaaaccacaagtt  1819
            ||||||||||||||||||||||||||||||||||||||||||||||||||||||||||||
V.2:  1504  cactggacttatcacaatcaaagaaccactggatagggaagaaacaccaaaccacaagtt  1563

V.1:  1820  actggttttggcaagtgatggtggattgatgccagcaagagcaatggtgctggtaaatgt  1879
            ||||||||||||||||||||||||||||||||||||||||||||||||||||||||||||
V.2:  1564  actggttttggcaagtgatggtggattgatgccagcaagagcaatggtgctggtaaatgt  1623

V.1:  1880  tacagatgtcaatgataatgtcccatccattgacataagatacatcgtcaatcctgtcaa  1939
            ||||||||||||||||||||||||||||||||||||||||||||||||||||||||||||
V.2:  1624  tacagatgtcaatgataatgtcccatccattgacataagatacatcgtcaatcctgtcaa  1683

V.1:  1940  tgacacagttgttctttcagaaaatattccactcaacaccaaaattgctctcataactgt  1999
            ||||||||||||||||||||||||||||||||||||||||||||||||||||||||||||
V.2:  1684  tgacacagttgttctttcagaaaatattccactcaacaccaaaattgctctcataactgt  1743

V.1:  2000  gacggataaggatgcggaccataatggcagggtgacatgcttcacagatcatgaaatccc  2059
            ||||||||||||||||||||||||||||||||||||||||||||||||||||||||||||
V.2:  1744  gacggataaggatgcggaccataatggcagggtgacatgcttcacagatcatgaaatccc  1803

V.1:  2060  tttcagattaaggccagtattcagtaatcagttcctcctggagactgcagcatatcttga  2119
            ||||||||||||||||||||||||||||||||||||||||||||||||||||||||||||
V.2:  1804  tttcagattaaggccagtattcagtaatcagttcctcctggagactgcagcatatcttga  1863

V.1:  2120  ctatgagtccacaaaagaatatgccattaaattactggctgcagatgctggcaaacctcc  2179
            ||||||||||||||||||||||||||||||||||||||||||||||||||||||||||||
V.2:  1864  ctatgagtccacaaaagaatatgccattaaattactggctgcagatgctggcaaacctcc  1923

V.1:  2180  tttgaatcagtcagcaatgctcttcatcaaagtgaaagatgaaaatgacaatgctccagt  2239
            ||||||||||||||||||||||||||||||||||||||||||||||||||||||||||||
V.2:  1924  tttgaatcagtcagcaatgctcttcatcaaagtgaaagatgaaaatgacaatgctccagt  1983

V.1:  2240  tttcacccagtctttcgtaactgtttctattcctgagaataactctcctggcatccagtt  2299
            ||||||||||||||||||||||||||||||||||||||||||||||||||||||||||||
V.2:  1984  tttcacccagtctttcgtaactgtttctattcctgagaataactctcctggcatccagtt  2043

V.1:  2300  gacgaaagtaagtgcaatggatgcagacagtgggcctaatgctaagatcaattacctgct  2359
            ||||||||||||||||||||||||||||||||||||||||||||||||||||||||||||
V.2:  2044  gacgaaagtaagtgcaatggatgcagacagtgggcctaatgctaagatcaattacctgct  2103

V.1:  2360  aggccctgatgctccacctgaattcagcctggattgtcgtacaggcatgctgactgtagt  2419
            ||||||||||||||||||||||||||||||||||||||||||||||||||||||||||||
V.2:  2104  aggccctgatgctccacctgaattcagcctggattgtcgtacaggcatgctgactgtagt  2163

V.1:  2420  gaagaaactagatagagaaaaagaggataaatatttattcacaattctggcaaaagataa  2479
            ||||||||||||||||||||||||||||||||||||||||||||||||||||||||||||
V.2:  2164  gaagaaactagatagagaaaaagaggataaatatttattcacaattctggcaaaagataa  2223

V.1:  2480  cggggtaccacccttaaccagcaatgtcacagtctttgtaagcattattgatcagaatga  2539
            ||||||||||||||||||||||||||||||||||||||||||||||||||||||||||||
V.2:  2224  cggggtaccacccttaaccagcaatgtcacagtctttgtaagcattattgatcagaatga  2283

V.1:  2540  caatagcccagttttcactcacaatgaatacaacttctatgtcccagaaaaccttccaag  2599
            ||||||||||||||||||||||||||||||||||||||||||||||||||||||||||||
V.2:  2284  caatagcccagttttcactcacaatgaatacaacttctatgtcccagaaaaccttccaag  2343

V.1:  2600  gcatggtacagtaggactaatcactgtaactgatcctgattatggagacaattctgcagt  2659
            ||||||||||||||||||||||||||||||||||||||||||||||||||||||||||||
V.2:  2344  gcatggtacagtaggactaatcactgtaactgatcctgattatggagacaattctgcagt  2403

V.1:  2660  tacgctctccattttagatgagaatgatgacttcaccattgattcacaaactggtgtcat  2719
            ||||||||||||||||||||||||||||||||||||||||||||||||||||||||||||
V.2:  2404  tacgctctccattttagatgagaatgatgacttcaccattgattcacaaactggtgtcat  2463

V.1:  2720  ccgaccaaatatttcatttgatagagaaaaacaagaatcttacactttctatgtaaaggc  2779
            ||||||||||||||||||||||||||||||||||||||||||||||||||||||||||||
V.2:  2464  ccgaccaaatatttcatttgatagagaaaaacaagaatcttacactttctatgtaaaggc  2523

V.1:  2780  tgaggatggtggtagagtatcacgttcttcaagtgccaaagtaaccataaatgtggttga  2839
            ||||||||||||||||||||||||||||||||||||||||||||||||||||||||||||
V.2:  2524  tgaggatggtggtagagtatcacgttcttcaagtgccaaagtaaccataaatgtggttga  2583
```

TABLE LIII(a) -continued

Nucleotide sequence alignment of 109P1D4 v.1 (SEQ ID NO: 238) and
109P1D4 v.2 (SEQ ID NO: 239) Score = 5920 bits (3079),
Expect = 0.0 Identities = 3079/3079 (100%) Strand = Plus/Plus

```
V.1:   2840  tgtcaatgacaacaaaccagttttcattgtccctccttccaactgttcttatgaattggt  2899
             ||||||||||||||||||||||||||||||||||||||||||||||||||||||||||||
V.2:   2584  tgtcaatgacaacaaaccagttttcattgtccctccttccaactgttcttatgaattggt  2643

V.1:   2900  tctaccgtccactaatccaggcacagtggtctttcaggtaattgctgttgacaatgacac  2959
             ||||||||||||||||||||||||||||||||||||||||||||||||||||||||||||
V.2:   2644  tctaccgtccactaatccaggcacagtggtctttcaggtaattgctgttgacaatgacac  2703

V.1:   2960  tggcatgaatgcagaggttcgttacagcattgtaggaggaaacaagagatctgtttgc    3019
             ||||||||||||||||||||||||||||||||||||||||||||||||||||||||||||
V.2:   2704  tggcatgaatgcagaggttcgttacagcattgtaggaggaaacaagagatctgtttgc    2763

V.1:   3020  aatcgaccaagaaacaggcaacataacattgatggagaaatgtgatgttacagaccttgg  3079
             ||||||||||||||||||||||||||||||||||||||||||||||||||||||||||||
V.2:   2764  aatcgaccaagaaacaggcaacataacattgatggagaaatgtgatgttacagaccttgg  2823

V.1:   3080  tttacacagagtgttggtcaaagctaatgacttaggacagcctgattctctcttcagtgt  3139
             ||||||||||||||||||||||||||||||||||||||||||||||||||||||||||||
V.2:   2824  tttacacagagtgttggtcaaagctaatgacttaggacagcctgattctctcttcagtgt  2883

V.1:   3140  tgtaattgtcaatctgttcgtgaatgagtcggtgaccaatgctacactgattaatgaact  3199
             ||||||||||||||||||||||||||||||||||||||||||||||||||||||||||||
V.2:   2884  tgtaattgtcaatctgttcgtgaatgagtcggtgaccaatgctacactgattaatgaact  2943

V.1:   3200  ggtgcgcaaaagcactgaagcaccagtgaccccaaatactgagatagctgatgtatcctc  3259
             ||||||||||||||||||||||||||||||||||||||||||||||||||||||||||||
V.2:   2944  ggtgcgcaaaagcactgaagcaccagtgaccccaaatactgagatagctgatgtatcctc  3003

V.1:   3260  accaactagtgactatgtcaagatcctggttgcagctgttgctggcaccataactgtcgt  3319
             ||||||||||||||||||||||||||||||||||||||||||||||||||||||||||||
V.2:   3004  accaactagtgactatgtcaagatcctggttgcagctgttgctggcaccataactgtcgt  3063

V.1:   3320  tgtagttattttcatcactgctgtagtaagatgtcgccaggcaccacaccttaaggctgc  3379
             ||||||||||||||||||||||||||||||||||||||||||||||||||||||||||||
V.2:   3064  tgtagttattttcatcactgctgtagtaagatgtcgccaggcaccacaccttaaggctgc  3123

V.1:   3380  tcagaaaaacaagcagaattctgaatgggctaccccaaacccagaaaacaggcagatgat  3439
             ||||||||||||||||||||||||||||||||||||||||||||||||||||||||||||
V.2:   3124  tcagaaaaacaagcagaattctgaatgggctaccccaaacccagaaaacaggcagatgat  3183

V.1:   3440  aatgatgaagaaaagaaaaagaagaagaagcattcccctaagaacttgctgcttaattt   3499
             ||||||||||||||||||||||||||||||||||||||||||||||||||||||||||||
V.2:   3184  aatgatgaagaaaagaaaaagaagaagaagcattcccctaagaacttgctgcttaattt   3243

V.1:   3500  tgtcactattgaagaaactaaggcagatgatgttgacagtgatggaaacagagtcacact  3559
             ||||||||||||||||||||||||||||||||||||||||||||||||||||||||||||
V.2:   3244  tgtcactattgaagaaactaaggcagatgatgttgacagtgatggaaacagagtcacact  3303

V.1:   3560  agaccttcctattgatctagaagagcaaacaatgggaaagtacaattgggtaactacacc  3619
             ||||||||||||||||||||||||||||||||||||||||||||||||||||||||||||
V.2:   3304  agaccttcctattgatctagaagagcaaacaatgggaaagtacaattgggtaactacacc  3363

V.1:   3620  tactactttcaagcccgacagccctgatttggcccgacactacaaatctgcctctccaca  3679
             ||||||||||||||||||||||||||||||||||||||||||||||||||||||||||||
V.2:   3364  tactactttcaagcccgacagccctgatttggcccgacactacaaatctgcctctccaca  3423

V.1:   3680  gcctgccttccaaattcagcctgaaactcccctgaattcgaagcaccacatcatccaaga  3739
             ||||||||||||||||||||||||||||||||||||||||||||||||||||||||||||
V.2:   3424  gcctgccttccaaattcagcctgaaactcccctgaattcgaagcaccacatcatccaaga  3483

V.1:   3740  actgcctctcgataacacctttgtggcctgtgactctatctccaagtgttcctcaagcag  3799
             ||||||||||||||||||||||||||||||||||||||||||||||||||||||||||||
V.2:   3484  actgcctctcgataacacctttgtggcctgtgactctatctccaagtgttcctcaagcag  3543

V.1:   3800  ttcagatccctacagcgtttctgactgtggctatccagtgacgaccttcgaggtacctgt  3859
             ||||||||||||||||||||||||||||||||||||||||||||||||||||||||||||
V.2:   3544  ttcagatccctacagcgtttctgactgtggctatccagtgacgaccttcgaggtacctgt  3603

V.1:   3860  gtccgtacacaccagaccg                                           3878
             |||||||||||||||||||
V.2:   3604  gtccgtacacaccagaccg                                           3622
```

TABLE LIV(a)

Peptide sequences of protein coded by 109P1D4 v.2 (SEQ ID NO: 240)

```
MRTERQWVLI QIFQVLCGLI QQTVTSVPGM DLLSGTYIFA VLLACVVFHS GAQEKNYTIR    60
EEMPENVLIG DLLKDLNLSL IPNKSLTTAM QFKLVYKTGD VPLIRIEEDT GEIFTTGARI   120
DREKLCAGIP RDEHCFYEVE VAILPDEIFR LVKIRFLIED INDNAPLFPA TVINISIPEN   180
SAINSKYTLP AAVDPDVGIN GVQNYELIKS QNIFGLDVIE TPEGDKMPQL IVQKELDREE   240
KDTYVMKVKV EDGGFPQRSS TAILQVSVTD TNDNHPVFKE TEIEVSIPEN APVGTSVTQL   300
HATDADIGEN AKIHFSFSNL VSNIARRLFH LNATTGLITI KEPLDREETP NHKLLVLASD   360
GGLMPARAMV LVNVTDVNDN VPSIDIRYIV NPVNDTVVLS ENIPLNTKIA LITVTDKDAD   420
HNGRVTCFTD HEIPFRLRPV FSNQFLLETA AYLDYESTKE YAIKLLAADA GKPPLNQSAN   480
LFIKVKDEND NAPVFTQSFV TVSIPENNSP GIQLTKVSAM DADSGPNAKI NYLLGPDAPP   540
EFSLDCRTGM LTVVKKLDRE KEDKYLFTIL AKDNGVPPLT SNVTVFVSII DQNDNSPVFT   600
HNEYNFYVPE NLPRHGTVGL ITVTDPDYGD NSAVTLSILD ENDDFTIDSQ TGVIRPNISF   660
DREKQESYTF YVKAEDGGRV SRSSSAKVTI NVVDVNDNKP VFIVPPSNCS YELVLPSTNP   720
GTVVFQVIAV DNDTGMNAEV RYSIVGGNTR DLFAIDQETG NITLMEKCDV TDLGLHRVLV   780
KANDLGQPDS LFSVVIVNLF VNESVTNATL TNELVRKSTE APVTPNTEIA DVSSPTSDYV   840
KILVAAVAGT ITVVVIFIT AVVRCRQAPH LKAAQKNKQN SEWATPNPEN RQMIMMKKKK    900
KKKKHSPKNL LLNFVTIEET KADDVDSDGN RVTLDLPIDL EEQTMGKYNW VTTPTTFKPD   960
SPDLARHYKS ASPQPAFQIQ PETPLNSKHH IIQELPLDNT FVACDSISKC SSSSSDPYSV  1020
SDCGYPVTTF EVPVSVHTRP TDSRTSTIEI CSEI                              1054
```

TABLE LV(a)

Amino acid sequence alignment of 109P1D4 v.1 (SEQ ID NO: 241) and 109P1D4 v.2 (SEQ ID NO: 242) Score = 2006 bits (5197), Expect = 0.0Identities = 1012/1017 (99%), Positives = 1013/1017 (99%)

```
V.1    1 MDLLSGTYIFAVLLACVVFHSGAQEKNYTIREEMPENVLIGDLLKDLNLSLIPNKSLTTA  60
         MDLLSGTYIFAVLLACVVFHSGAQEKNYTIREEMPENVLIGDLLKDLNLSLIPNKSLTTA
V.2   30 MDLLSGTYIFAVLLACVVFHSGAQEKNYTIREEMPENVLIGDLLKDLNLSLIPNKSLTTA  89

V.1   61 MQFKLVYKTGDVPLIRIEEDTGEIFTTGARIDREKLCAGIPRDEHCFYEVEVAILPDEIF 120
         MQFKLVYKTGDVPLIRIEEDTGEIFTTGARIDREK CAGIPRDEHCFYEVEVAILPDEIF
V.2   90 MQFKLVYKTGDVPLIRIEEDTGEIFTTGARIDREKICAGIPRDEHCFYEVEVAILPDEIF 149

V.1  121 RLVKIRFLIEDINDNAPLFPATVINISIPENSAINSKYTLPAAVDPDVGINGVQNYELIK 180
         RLVKIRFLIEDINDNAPLFPATVINISIPENSAINSKYTLPAAVDPDVGINGVQNYELIK
V.2  150 RLVKIRFLIEDINDNAPLFPATVINISIPENSAINSKYTLPAAVDPDVGINGVQNYELIK 209

V.1  181 SQNIFGLDVIETPEGDKNPQLIVQKELDREEKDTYVMKVKVEDGGFPQRSSTAILQVSVT 240
         SQNIFGLDVIETPEGDK PQLIVQKELDREEKDTYVMKVKVEDGGFPQRSSTAILQVSVT
V.2  210 SQNIFGLDVIETPEGDKMPQLIVQKELDREEKDTYVMKVKVEDGGFPQRSSTAILQVSVT 269

V.1  241 DTNDNHPVFKETEIEVSIPENAPVGTSVTQLHATDADIGENAKIHFSFSNLVSNIARRLF 300
         DTNDNHPVFKETEIEVSIPENAPVGTSVTQLHATDADIGENAKIHFSFSNLVSNIARRLF
V.2  270 DTNDNHPVFKETEIEVSIPENAPVGTSVTQLHATDADIGENAKIHFSFSNLVSNIARRLF 329

V.1  301 HLNATTGLITIKEPLDREETPNHKLLVLASDGGLMPAPAMVLVNVTDVNDNVPSIDIRYI 360
         HLNATTGLITIKEPLDREETPNHKLLVLASDGGLMPA AMVLVNVTDVNDNVPSIDIRYI
V.2  330 HLNATTGLITIKEPLDREETPNHKLLVLASDGGLMPARAMVLVNVTDVNDNVPSIDIRYI 389

V.1  361 VNPVNDTVVLSENIPLNTKIALITVTDKDADMNGRVTCFTDHEIPFRLRPVFSNQFLLET 420
         VNPVNDTVVLSENIPLNTKIALITVTDKDAD NGRVTCFTDHEIPFRLRPVFSNQFLLET
V.2  390 VNPVNDTVVLSENIPLNTKIALITVTDKDADHNGRVTCFTDHEIPFRLRPVFSNQFLLET 449

V.1  421 AAYLDYESTKEYAIKLLAADAGKPPLNQSAMLFIKVKDENDNAPVFTQSFVTVSIPENNS 480
         AAYLDYESTKEYAIKLLAADAGKPPLNQSA LFIKVKDENDNAPVFTQSFVTVSIPENNS
V.2  450 AAYLDYESTKEYAIKLLAADAGKPPLNQSANLFIKVKDENDNAPVFTQSFVTVSIPENNS 509
```

TABLE LV(a)-continued

Amino acid sequence alignment of 109P1D4 v.1 (SEQ ID NO: 241) and 109P1D4 v.2 (SEQ ID NO: 242) Score = 2006 bits (5197), Expect = 0.0 Identities = 1012/1017 (99%), Positives = 1013/1017 (99%)

```
V.1 481 PGIQLTKVSANDADSGPNAKINYLLGPDAPPEFSLDCRTGMLTVVKKLDREKEDKYLFTI 540
        PGIQLTKVSAMDADSGPNAKINYLLGPDAPPEFSLDCRTGMLTVVKKLDREKEDKYLFTI
V.2 510 PGIQLTKVSAMDADSGPNAKINYLLGPDAPPEFSLDCRTGMLTVVKKLDREKEDKYLFTl 569

V.1 541 LAKDNGVPPLTSNVTVFVSIIDQNDNSPVFTRNEYNFYVPENLPRHGTVGLITVTDPDYG 600
        LAKDNGVPPLTSNVTVFVSIIDQNDNSPVFTHNEYNFYVPENLPRHGTVGLITVTDPDYG
V.2 570 LAKDNGVPPLTSNVTVFVSIIDQNDNSPVFTHNEYNFYVPENLPRHGTVGLITVTDPDYG 629

V.1 601 DNSAVTLSILDENDDFTIDSQTGVIRPNISFDREKQESYTFYVKAEDGGRVSRSSSAKVT 660
        DNSAVTLSILDENDDFTIDSQTGVIRPNISFDREKQESYTFYVKAEDGGRVSRSSSAKVT
V.2 630 DNSAVTLSILDENDDFTIDSQTGVIRPNISFDREKQESYTFYVKAEDGGRVSRSSSAKVT 689

V.1 661 INVVDVNDNKPVFIVPPSNCSYELVLPSTNPGTVVFQVIAVDNDTGMNAEVRYSIVGGNT 720
        INVVDVNDNKPVFIVPPSNCSYELVLPSTNPGTVVFQVIAVDNDTGMNAEVRYSIVGGNT
V.2 690 INVVDVNDNKPVFIVPPSNCSYELVLPSTNPGTVVFQVIAVDNDTGMNAEVRYSIVGGNT 749

V.1 721 RDLFAIDQETGNITLMEKCDVTDLGLHRVLVKANDLGQPDSLFSVVIVNLFVNESVTNAT 780
        RDLFAIDQETGNITLMEKCDVTDLGLMRVLVKANDLGQPDSLFSVVIVNLFVNESVTNAT
V.2 750 RDLFAIDQETGNITLMEKCDVTDLGLMRVLVKANDLGQPDSLFSVVIVNLFVNESVTNAT 809

V.1 781 LINELVRKSTEAPVTPNTEIADVSSPTSDYVKILVAAVAGTITVVVVIFITAVVRCRQAP 840
        LINELVRKSTEAPVTPNTEIADVSSPTSDYVKILVAAVAGTITVVVVIFITAVVRCRQAP
V.2 810 LINELVRKSTEAPVTPNTEIADVSSPTSDYVKILVAAVAGTITVVVVIFITAVVRCRQAP 869

V.1 841 KLKAAQKNKQNSEWATPNPENRQMIMMKKKKKKKHSPKNLLLNFVTIEETKADDVDSDG 900
        KLKAAQKNKQNSEWATPNPENRQMIMMKKKKKKKHSPKNLLLNFVTIEETKADDVDSDG
V.2 870 KLKAAQKNKQNSEWATPNPENRQMIMMKKKKKKKHSPKNLLLNFVTIEETKADDVDSDG 929

V.1 901 NRVTLDLPIDLEEQTMGKYNWVTTPTTFKPDSPDLARHYKSASPQPAFQIQPETPLNSKH 960
        NRVTLDLPIDLEEQTMGKYNWVTTPTTFKPDSPDLARHYKSASPQPAFQIQPETPLNSKH
V.2 930 NRVTLDLPIDLEEQTMGKYNWVTTPTTFKPDSPDLARHYKSASPQPAFQIQPETPLNSKH 989

V.1 961 HIIQELPLDNTFVACDSISKCSSSSSDPYSVSDCGYPVTTFEVPVSVHTRPVGIQVS 1017
        HIIQELPLDNTFVACDSISKCSSSSSDPYSVSDCGYPVTTFEVPVSVHTRP   + S
V.2 990 HIIQELPLDNTFVACDSISKCSSSSSDPYSVSDCGYPVTTFEVPVSVHTRPTDSRTS 1046
```

TABLE LII(b)

| Nucleotide sequence of transcript variant 109P1D4 v.3 (SEQ ID NO: 243) | |
|---|---|
| ctggtggtcc agtacctcca aagatatgga atacactcct gaaatatcct gaaaactttt | 60 |
| ttttttcaga atcctttaat aagcagttat gtcaatctga agttgctta cttgtacttt | 120 |
| atattaatag ctattcttgt ttttcttatc caaagaaaaa tcctctaatc ccctttcac | 180 |
| atgatagttg ttaccatgtt taggcattag tcacatcaac ccctctcctc tcccaaactt | 240 |
| ctcttcttca aatcaaactt tattagtccc tccttataa tgattcctg cctcgttta | 300 |
| tccagatcaa ttttttttca ctttgatgcc cagagctgaa gaaatggact actgtataaa | 360 |
| ttattcattg ccaagagaat aattgcattt taaacccata ttataacaaa gaataatgat | 420 |
| tatattttgt gatttgtaac aaatacccct tatttccct taactattga attaaatatt | 480 |
| ttaattattt gtattctctt taactatctt ggtatattaa agtattatct tttatatatt | 540 |
| tatcaatggt ggacactttt ataggtactc tgtgtcattt ttgatactgt aggtatctta | 600 |
| tttcatttat ctttattctt aatgtacgaa tcataataat ttgattcaga acaaatttat | 660 |
| cactaattaa cagagtgtca attatgctaa catctcattt actgatttta atttaaaaca | 720 |
| gttttttgtta acatgcatgt ttaggggttgg cttcttaata atttcttctt cctcttctct | 780 |
| ctctcctctt cttttggtca gtgttgtgcg ggttaataca acaaactgta acaagtgtac | 840 |
| ctggtatgga cttgttgtcc gggacgtaca ttttcgcggt cctgctagca tgcgtggtgt | 900 |
| tccactctgg cgcccaggag aaaaactaca ccatccgaga gaaatgccaa gaaaacgtcc | 960 |

TABLE LII(b)-continued

Nucleotide sequence of transcript variant 109P1D4 v.3 (SEQ ID NO: 243)

| | | | | | |
|---|---|---|---|---|---|
| tgataggcga | cttgttgaaa | gaccttaact | tgtcgctgat | tccaaacaag | tccttgacaa | 1020 |
| ctgctatgca | gttcaagcta | gtgtacaaga | ccggagatgt | gccactgatt | cgaattgaag | 1080 |
| aggatactgg | tgagatcttc | actactggcg | ctcgcattga | tcgtgagaaa | ttatgtgctg | 1140 |
| gtatcccaag | ggatgagcat | tgcttttatg | aagtggaggt | tgccatttg | ccggatgaaa | 1200 |
| tatttagact | ggttaagata | cgttttctga | tagaagatat | aaatgataat | gcaccattgt | 1260 |
| tcccagcaac | agttatcaac | atatcaattc | cagagaactc | ggctataaac | tctaaatata | 1320 |
| ctctcccagc | ggctgttgat | cctgacgtag | gaataaacgg | agttcaaaac | tacgaactaa | 1380 |
| ttaagagtca | aaacatttt | ggcctcgatg | tcattgaaac | accagaagga | gacaagatgc | 1440 |
| cacaactgat | tgttcaaaag | gagttagata | gggaagagaa | ggatacctac | gtgatgaaag | 1500 |
| taaaggttga | agatggtggc | tttcctcaaa | gatccagtac | tgctatttg | caagtgagtg | 1560 |
| ttactgatac | aaatgacaac | cacccagtct | taaggagac | agagattgaa | gtcagtatac | 1620 |
| cagaaaatgc | tcctgtaggc | acttcagtga | cacagctcca | tgccacagat | gctgacatag | 1680 |
| gtgaaaatgc | caagatccac | ttctctttca | gcaatctagt | ctccaacatt | gccaggagat | 1740 |
| tatttcacct | caatgccacc | actggactta | tcacaatcaa | agaaccactg | gatagggaag | 1800 |
| aaacaccaaa | ccacaagtta | ctggtttgg | caagtgatgg | tggattgatg | ccagcaagag | 1860 |
| caatggtgct | ggtaaatgtt | acagatgtca | atgataatgt | cccatccatt | gacataagat | 1920 |
| acatcgtcaa | tcctgtcaat | gacacagttg | ttctttcaga | aaatattcca | ctcaacacca | 1980 |
| aaattgctct | cataactgtg | acggataagg | atgcggacca | taatggcagg | gtgacatgct | 2040 |
| tcacagatca | tgaaatccct | ttcagattaa | ggccagtatt | cagtaatcag | ttcctcctgg | 2100 |
| agactgcagc | atatcttgac | tatgagtcca | caaaagaata | tgccattaaa | ttactggctg | 2160 |
| cagatgctgg | caaacctcct | ttgaatcagt | cagcaatgct | cttcatcaaa | gtgaaagatg | 2220 |
| aaaatgacaa | tgctccagtt | ttcacccagt | ctttcgtaac | tgtttctatt | cctgagaata | 2280 |
| actctcctgg | catccagttg | acgaaagtaa | gtgcaatgga | tgcagacagt | gggcctaatg | 2340 |
| ctaagatcaa | ttacctgcta | ggccctgatg | ctccacctga | attcagcctg | gattgtcgta | 2400 |
| caggcatgct | gactgtagtg | aagaaactag | atagagaaaa | agaggataaa | tatttattca | 2460 |
| caattctggc | aaaagataac | ggggtaccac | ccttaaccag | caatgtcaca | gtctttgtaa | 2520 |
| gcattattga | tcagaatgac | aatagcccag | ttttcactca | caatgaatac | aacttctatg | 2580 |
| tcccagaaaa | ccttccaagg | catggtacag | taggactaat | cactgtaact | gatcctgatt | 2640 |
| atggagacaa | ttctgcagtt | acgctctcca | ttttagatga | gaatgatgac | ttcaccattg | 2700 |
| attcacaaac | tggtgtcatc | cgaccaaata | tttcatttga | tagagaaaaa | caagaatctt | 2760 |
| acactttcta | tgtaaaggct | gaggatggtg | gtagagtatc | acgttcttca | agtgccaaag | 2820 |
| taaccataaa | tgtggttgat | gtcaatgaca | acaaaccagt | tttcattgtc | cctccttcca | 2880 |
| actgttctta | tgaattggtt | ctaccgtcca | ctaatccagg | cacagtggtc | tttcaggtaa | 2940 |
| ttgctgttga | caatgacact | ggcatgaatg | cagaggttcg | ttacagcatt | gtaggaggaa | 3000 |
| acacaagaga | tctgtttgca | atcgaccaag | aaacaggcaa | cataacattg | atggagaaat | 3060 |
| gtgatgttac | agaccttggt | ttacacagag | tgttggtcaa | agctaatgac | ttaggacagc | 3120 |
| ctgattctct | cttcagtgtt | gtaattgtca | atctgttcgt | gaatgagtcg | gtgaccaatg | 3180 |
| ctacactgat | taatgaactg | gtgcgcaaaa | gcactgaagc | accagtgacc | ccaaatactg | 3240 |
| agatagctga | tgtatcctca | ccaactagtg | actatgtcaa | gatcctggtt | gcagctgttg | 3300 |

TABLE LII(b)-continued

Nucleotide sequence of transcript variant 109P1D4 v.3 (SEQ ID NO: 243)

| | | | | | |
|---|---|---|---|---|---|
| ctggcaccat | aactgtcgtt | gtagttattt | tcatcactgc | tgtagtaaga | tgtcgccagg | 3360 |
| caccacacct | taaggctgct | cagaaaaaca | agcagaattc | tgaatgggct | accccaaacc | 3420 |
| cagaaaacag | gcagatgata | atgatgaaga | aaagaaaaa | gaagaagaag | cattcccta | 3480 |
| agaacttgct | gcttaatttt | gtcactattg | aagaaactaa | ggcagatgat | gttgacagtg | 3540 |
| atggaaacag | agtcacacta | gaccttccta | ttgatctaga | agagcaaaca | atgggaaagt | 3600 |
| acaattgggt | aactacacct | actactttca | agcccgacag | ccctgatttg | gcccgacact | 3660 |
| acaaatctgc | ctctccacag | cctgccttcc | aaattcagcc | tgaaactccc | ctgaattcga | 3720 |
| agcaccacat | catccaagaa | ctgcctctcg | ataacacctt | tgtggcctgt | gactctatct | 3780 |
| ccaagtgttc | ctcaagcagt | tcagatccct | acagcgtttc | tgactgtggc | tatccagtga | 3840 |
| cgaccttcga | ggtacctgtg | tccgtacaca | ccagaccgcc | aatgaaggag | gttgtgcgat | 3900 |
| cttgcacccc | catgaaagag | tctacaacta | tggagatctg | gattcatccc | caaccacagc | 3960 |
| ggaaatctga | agggaaagtg | gcaggaaagt | cccagcggcg | tgtcacattt | cacctgccag | 4020 |
| aaggctctca | ggaaagcagc | agtgatggtg | gactgggaga | ccatgatgca | ggcagcctta | 4080 |
| ccageacatc | tcatggcctg | ccccttggct | atcctcagga | ggagtacttt | gatcgtgcta | 4140 |
| cacccagcaa | tcgcactgaa | ggggatggca | actccgatcc | tgaatctact | ttcatacctg | 4200 |
| gactaaagaa | agctgcagaa | ataactgttc | aaccaactgt | ggaagaggcc | tctgacaact | 4260 |
| gcactcaaga | atgtctcatc | tatggccatt | ctgatgcctg | ctggatgccg | gcatctctgg | 4320 |
| atcattccag | ctcttcgcaa | gcacaggcct | ctgctctatg | ccagagccca | ccactgtcac | 4380 |
| aggcctctac | tcagcaccac | agcccacgag | tgacacagac | cattgctctc | tgccacagcc | 4440 |
| ctccagtgac | acagaccatc | gcattgtgcc | acagcccacc | accgatacag | gtgtctgctc | 4500 |
| tccaccacag | tcctcctcta | gtgcaggcta | ctgcacttca | ccacagccca | ccatcagcac | 4560 |
| aggcctcagc | cctctgctac | agccctcctt | tagcacaggc | tgctgcaatc | agccacagct | 4620 |
| ctcctctgcc | acaggttatt | gccctccatc | gtagtcaggc | ccaatcatca | gtcagtttgc | 4680 |
| agcaaggttg | ggtgcaaggt | gctgatgggc | tatgctctgt | tgatcaggga | gtgcaaggta | 4740 |
| gtgcaacatc | tcagtttac | accatgtctg | aaagacttca | tcccagtgat | gattcaatta | 4800 |
| aagtcattcc | tttgacaacc | ttcactccac | gccaacaggc | cagaccgtcc | agaggtgatt | 4860 |
| cccccattat | ggaagaacat | cccttgtaaa | gctaaaatag | ttacttcaaa | ttttcagaaa | 4920 |
| agatgtatat | agtcaaaatt | taagatacaa | ttccaatgag | tattctgatt | atcagatttg | 4980 |
| taaataacta | tgtaaataga | aacagatacc | agaataaatc | tacagctaga | cccttagtca | 5040 |
| atagttaacc | aaaaaattgc | aatttgttta | attcagaatg | tgtatttaaa | aagaaaagga | 5100 |
| atttaacaat | ttgcatcccc | ttgtacagta | aggcttatca | tgacagagcg | cactatttct | 5160 |
| gatgtacagt | atttttgtt | gtttttatca | tcatgtgcaa | tattactgat | ttgtttccat | 5220 |
| gctgattgtg | tggaaccagt | atgtagcaaa | tggaaagcct | agaaatatct | tattttctaa | 5280 |
| gtttaccttt | agtttaccta | aacttttgtt | cagataacgt | taaaaggtat | acgtactcta | 5340 |
| gccttttttt | gggctttctt | tttgatttt | gtttgttgtt | ttcagttttt | ttgttgttgt | 5400 |
| tagtgagtct | cccttcaaaa | tacgcagtag | gtagtgtaaa | tactgcttgt | ttgtgtctct | 5460 |
| ctgctgtcat | gttttctacc | ttattccaat | actatattgt | tgataaaatt | tgtatataca | 5520 |
| ttttcaataa | agaatatgta | taaactgtac | agatatagat | ctacaaccta | tttctctact | 5580 |
| ctttagtaga | gttcgagaca | cagaagtgca | ataactgccc | taattaagca | actatttgtt | 5640 |

TABLE LII(b)-continued

Nucleotide sequence of transcript variant 109P1D4 v.3 (SEQ ID NO: 243)

```
aaaaagggcc tcttttact ttaatagttt agtgtaaagt acatcagaaa taaagctgta      5700
tctgccattt taagcctgta gtccattatt acttgggtct ttacttctgg gaatttgtat      5760
gtaacagcct agaaaattaa aaggaggtgg atgcatccaa agcacgagtc acttaaaata      5820
tcgacggtaa actactattt tgtagagaaa ctcaggaaga tttaaatgtt gatttgacag      5880
ctcaataggc tgttaccaaa gggtgttcag taaaaataac aaatacatgt aactgtagat      5940
aaaccatat  actaaatcta taagactaag ggattttgt  tattctagct caacttactg      6000
aagaaaacca ctaataacaa caagaatatc aggaaggaac ttttcaagaa atgtaattat      6060
aaatctacat caaacagaat tttaaggaaa aatgcagagg gagaaataag gcacatgact      6120
gcttcttgca gtcaacaaga aataccaata acacacacag aacaaaaacc atcaaaatct      6180
catatatgaa ataaaatata ttcttctaag caaagaaaca gtactattca tagaaaacat      6240
tagttttctt ctgttgtctg ttatttcctt cttgtatcct cttaactggc cattatcttg      6300
tatgtgcaca ttttataaat gtacagaaac atcaccaact taattttctt ccatagcaaa      6360
actgagaaaa taccttgttt cagtataaca ctaaaccaag agacaattga tgtttaatgg      6420
gggcggttgg ggtgggggggg ggagtcaata tctcctattg attaacttag acatagattt      6480
tgtaatgtat aacttgatat ttaatttatg attaaactgt gtgtaaattt tgtaacataa      6540
actgtggtaa ttgcataatt tcattggtga ggatttccac tgaatattga gaaagtttct      6600
tttcatgtgc ccagcaggtt aagtagcgtt ttcagaatat acattattcc catccattgt      6660
aaagttcctt aagtcatatt tgactgggcg tgcagaataa cttcttaact tttaactatc      6720
agagtttgat taataaaatt aattaatgtt ttttctcctt cgtgttgtta atgttccaag      6780
ggatttggag catactggtt ttccaggtgc atgtgaatcc cgaaggactg atgatatttg      6840
aatgtttatt aaattattat catacaaatg tgttgatatt gtggctattg ttgatgttga      6900
aaattttaaa cttggggaag attaagaaaa gaaccaatag tgacaaaaat cagtgcttcc      6960
agtagatttt agaacattct ttgcctcaaa aaacctgcaa agatgatgtg agattttttc      7020
ttgtgtttta attattttca cattttctct ctgcaaaact ttagttttct gatgatctac      7080
acacacacac acacacacac gtgcacacac acacacattt aaatgatata aaaagaagag      7140
gttgaaagat tattaaataa cttatcaggc atctcaatgg ttactatcta tgttagtgaa      7200
aatcaaatag gactcaaagt tggatatttg ggattttct  tctgacagta taatttattg      7260
agttactagg gaggttctta aatcctcata tctggaaact tgtgacgttt tgacacctt       7320
cctatagatg atataggaat gaaccaatac gcttttatta cccttctaa  ctctgatttt      7380
ataatcagac ttagattgtg tttagaatat taaatgactg ggcaccctct tcttggtttt      7440
taccagagag gctttgaatg gaagcaggct gagagtagcc aaagaggcaa ggggtattag      7500
cccagttatt ctcccctatg ccttccttct ctttctaagc gtccactagg tctggccttg      7560
gaaacctgtt acttctaggg cttcagatct gatgatatct ttttcatcac attacaagtt      7620
atttctctga ctgaatagac agtggtatag gttgacacag cacacaagtg gctattgtga      7680
tgtatgatgt atgtagtcct acaactgcaa aacgtcttac tgaaccaaca atcaaaaaat      7740
ggttctgttt taaaaaggat tttgtttgat ttgaaattaa aacttcaagc tgaatgactt      7800
atatgagaat aatacgttca atcaaagtag ttattctatt ttgtgtccat attccattag      7860
attgtgatta ttaattttct agctatggta ttactatatc acacttgtga gtatgtattc      7920
aaatactaag tatcttatat gctacgtgca tacacattct tttcttaaac tttacctgtg      7980
```

TABLE LII(b)-continued

Nucleotide sequence of transcript variant 109P1D4 v.3 (SEQ ID NO: 243)

```
ttttaactaa tattgtgtca gtgtattaaa aattagcttt tacatatgat atctacaatg    8040
taataaattt agagagtaat tttgtgtatt cttatttact taacatttta ctttttaatta   8100
tgtaaatttg gttagaaaat aataataaat ggttagtgct attgtgtaat ggtagcagtt    8160
acaaagagcc tctgccttcc caaactaata tttatcacac atggtcatta aatgggaaaa    8220
aaatagacta aacaaatcac aaattgttca gttcttaaaa tgtaattatg tcacacacac    8280
aaaaaatcct tttcaatcct gagaaaatta aaggcgtttt actcacatgg ctatttcaac    8340
attagttttt tttgtttgtt tcttttttcat ggtattactg aaggtgtgta tactccctaa   8400
tacacattta tgaaaatcta cttgtttagg cttttattta tactcttctg atttatattt    8460
tttattataa ttattatttc ttatcttttct tcttttatat tttttggaaa ccaaatttat   8520
agttagttta ggtaaacttt ttattatgac cattagaaac tattttgaat gcttccaact    8580
ggctcaattg gccgggaaaa catgggagca agagaagctg aaatatattt ctgcaagaac    8640
cttttctatat tatgtgccaa ttaccacacc agatcaattt tatgcagagg ccttaaaata   8700
ttctttcaca gtagctttct tacactaacc gtcatgtgct tttagtaaat atgattttta    8760
aaagcagttc aagttgacaa cagcagaaac agtaacaaaa aaatctgctc agaaaaatgt    8820
atgtgcacaa ataaaaaaaa ttaatggcaa ttgtttagtg attgtaagtg atactttta    8880
aagagtaaac tgtgtgaaat ttatactatc cctgcttaaa atattaagat ttttatgaaa    8940
tatgtattta tgtttgtatt gtgggaagat tcctcctctg tgatatcata cagcatctga    9000
aagtgaacag tatcccaaag cagttccaac catgctttgg aagtaagaag gttgactatt    9060
gtatggccaa ggatggcagt atgtaatcca gaagcaaact tgtattaatt gttctatttc    9120
aggttctgta ttgcatgttt tcttattaat atatattaat aaaagttatg agaaat        9176
```

TABLE LIII(b)

Nucleotide sequence alignment of 109P1D4 v.1 (SEQ ID NO: 244) and
109P1D4 v.3 (SEQ ID NO: 245) Score = 7456 bits (3878),
Expect = 0.0Identities = 3878/3878 (100%) Strand = Plus/Plus

```
V.1:    1  ctggtggtccagtacctccaaagatatggaatacactcctgaaatatcctgaaaactttt   60
           ||||||||||||||||||||||||||||||||||||||||||||||||||||||||||||
V.3:    1  ctggtggtccagtacctccaaagatatggaatacactcctgaaatatcctgaaaactttt   60

V.1:   61  tttttcagaatcctttaataagcagttatgtcaatctgaaagttgcttacttgtactttt  120
           ||||||||||||||||||||||||||||||||||||||||||||||||||||||||||||
V.3:   61  tttttcagaatcctttaataagcagttatgtcaatctgaaagttgcttacttgtactttt  120

V.1:  121  atattaatagctattcttgttttcttatccaaagaaaaatcctctaatccccttttcac   180
           ||||||||||||||||||||||||||||||||||||||||||||||||||||||||||||
V.3:  121  atattaatagctattcttgttttcttatccaaagaaaaatcctctaatccccttttcac   180

V.1:  181  atgatagttgttaccatgtttaggcattagtcacatcaaccccctctcctctcccaaactt  240
           ||||||||||||||||||||||||||||||||||||||||||||||||||||||||||||
V.3:  181  atgatagttgttaccatgtttaggcattagtcacatcaaccccctctcctctcccaaactt  240

V.1:  241  ctcttcttcaaatcaaactttattagtccctcctttataatgattccttgcctcgtttta   300
           ||||||||||||||||||||||||||||||||||||||||||||||||||||||||||||
V.3:  241  ctcttcttcaaatcaaactttattagtccctcctttataatgattccttgcctcgtttta   300

V.1:  301  tccagatcaatttttttcactttgatgcccagagctgaagaaatggactactgtataaa   360
           ||||||||||||||||||||||||||||||||||||||||||||||||||||||||||||
V.3:  301  tccagatcaatttttttcactttgatgcccagagctgaagaaatggactactgtataaa   360

V.1:  361  ttattcattgccaagagaataattgcattttaaacccatattataacaaagaataatgat  420
           ||||||||||||||||||||||||||||||||||||||||||||||||||||||||||||
V.3:  361  ttattcattgccaagagaataattgcattttaaacccatattataacaaagaataatgat  420
```

TABLE LIII(b)-continued

Nucleotide sequence alignment of 109P1D4 v.1 (SEQ ID NO: 244) and
109P1D4 v.3 (SEQ ID NO: 245) Score = 7456 bits (3878),
Expect = 0.0 Identities = 3878/3878 (100%) Strand = Plus/Plus

```
V.1:   421  tatattttgtgatttgtaacaaatacccttttattttcccttaactattgaattaaatatt  480
            ||||||||||||||||||||||||||||||||||||||||||||||||||||||||||||
V.3:   421  tatattttgtgatttgtaacaaatacccttttattttcccttaactattgaattaaatatt  480

V.1:   481  ttaattatttgtattctctttaactatcttggtatattaaagtattatctttatatatt  540
            ||||||||||||||||||||||||||||||||||||||||||||||||||||||||||||
V.3:   481  ttaattatttgtattctctttaactatcttggtatattaaagtattatctttatatatt  540

V.1:   541  tatcaatggtggacacttttataggtactctgtgtcattttgatactgtaggtatctta  600
            ||||||||||||||||||||||||||||||||||||||||||||||||||||||||||||
V.3:   541  tatcaatggtggacacttttataggtactctgtgtcattttgatactgtaggtatctta  600

V.1:   601  tttcatttatctttattcttaatgtacgaattcataatatttgattcagaacaaatttat  660
            ||||||||||||||||||||||||||||||||||||||||||||||||||||||||||||
V.3:   601  tttcatttatctttattcttaatgtacgaattcataatatttgattcagaacaaatttat  660

V.1:   661  cactaattaacagagtgtcaattatgctaacatctcatttactgattttaatttaaaaca  720
            ||||||||||||||||||||||||||||||||||||||||||||||||||||||||||||
V.3:   661  cactaattaacagagtgtcaattatgctaacatctcatttactgattttaatttaaaaca  720

V.1:   721  gttttgttaacatgcatgtttagggttggcttccttaataatttcttcttcctcttctct  780
            ||||||||||||||||||||||||||||||||||||||||||||||||||||||||||||
V.3:   721  gttttgttaacatgcatgtttagggttggcttccttaataatttcttcttcctcttctct  780

V.1:   781  ctctcctcttcttttggtcagtgttgtgcgggttaatacaacaaactgtaacaagtgtac  840
            ||||||||||||||||||||||||||||||||||||||||||||||||||||||||||||
V.3:   781  ctctcctcttcttttggtcagtgttgtgcgggttaatacaacaaactgtaacaagtgtac  840

V.1:   841  ctggtatggacttgttgtccgggacgtacattttcgcggtcctgctagcatgcgtggtgt  900
            ||||||||||||||||||||||||||||||||||||||||||||||||||||||||||||
V.3:   841  ctggtatggacttgttgtccgggacgtacattttcgcggtcctgctagcatgcgtggtgt  900

V.1:   901  tccactctggcgcccaggagaaaaactacaccatccgagaagaaatgccagaaaacgtcc  960
            ||||||||||||||||||||||||||||||||||||||||||||||||||||||||||||
V.3:   901  tccactctggcgcccaggagaaaaactacaccatccgagaagaaatgccagaaaacgtcc  960

V.1:   961  tgataggcgacttgttgaaagaccttaacttgtcgctgattccaaacaagtccttgacaa  1020
            ||||||||||||||||||||||||||||||||||||||||||||||||||||||||||||
V.3:   961  tgataggcgacttgttgaaagaccttaacttgtcgctgattccaaacaagtccttgacaa  1020

V.1:  1021  ctgctatgcagttcaagctagtgtacaagaccggagatgtgccactgattcgaattgaag  1080
            ||||||||||||||||||||||||||||||||||||||||||||||||||||||||||||
V.3:  1021  ctgctatgcagttcaagctagtgtacaagaccggagatgtgccactgattcgaattgaag  1080

V.1:  1081  aggatactggtgagatcttcactactggcgctcgcattgatcgtgagaaattatgtgctg  1140
            ||||||||||||||||||||||||||||||||||||||||||||||||||||||||||||
V.3:  1081  aggatactggtgagatcttcactactggcgctcgcattgatcgtgagaaattatgtgctg  1140

V.1:  1141  gtatcccaagggatgagcattgcttttatgaagtggaggttgccattttgccggatgaaa  1200
            ||||||||||||||||||||||||||||||||||||||||||||||||||||||||||||
V.3:  1141  gtatcccaagggatgagcattgcttttatgaagtggaggttgccattttgccggatgaaa  1200

V.1:  1201  tatttagactggttaagatacgttttctgatagaagatataaatgataatgcaccattgt  1260
            ||||||||||||||||||||||||||||||||||||||||||||||||||||||||||||
V.3:  1201  tatttagactggttaagatacgttttctgatagaagatataaatgataatgcaccattgt  1260

V.1:  1261  tcccagcaacagttatcaacatatcaattccagagaactcggctataaactctaaatata  1320
            ||||||||||||||||||||||||||||||||||||||||||||||||||||||||||||
V.3:  1261  tcccagcaacagttatcaacatatcaattccagagaactcggctataaactctaaatata  1320

V.1:  1321  ctctcccagcggctgttgatcctgacgtaggaataaacggagttcaaaactacgaactaa  1380
            ||||||||||||||||||||||||||||||||||||||||||||||||||||||||||||
V.3:  1321  ctctcccagcggctgttgatcctgacgtaggaataaacggagttcaaaactacgaactaa  1380

V.1:  1381  ttaagagtcaaaacatttttggcctcgatgtcattgaaacaccagaaggagacaagatgc  1440
            ||||||||||||||||||||||||||||||||||||||||||||||||||||||||||||
V.3:  1381  ttaagagtcaaaacatttttggcctcgatgtcattgaaacaccagaaggagacaagatgc  1440

V.1:  1441  cacaactgattgttcaaaaggagttagatagggaagagaaggatacctacgtgatgaaag  1500
            ||||||||||||||||||||||||||||||||||||||||||||||||||||||||||||
V.3:  1441  cacaactgattgttcaaaaggagttagatagggaagagaaggatacctacgtgatgaaag  1500

V.1:  1501  taaaggttgaagatggtggctttcctcaaagatccagtactgctattttgcaagtgagtg  1560
            ||||||||||||||||||||||||||||||||||||||||||||||||||||||||||||
V.3:  1501  taaaggttgaagatggtggctttcctcaaagatccagtactgctattttgcaagtgagtg  1560
```

TABLE LIII(b)-continued

Nucleotide sequence alignment of 109P1D4 v.1 (SEQ ID NO: 244) and
109P1D4 v.3 (SEQ ID NO: 245) Score = 7456 bits (3878),
Expect = 0.0Identities = 3878/3878 (100%) Strand = Plus/Plus

```
V.1:  1561  ttactgatacaaatgacaaccacccagtctttaaggagacagagattgaagtcagtatac  1620
            ||||||||||||||||||||||||||||||||||||||||||||||||||||||||||||
V.3:  1561  ttactgatacaaatgacaaccacccagtctttaaggagacagagattgaagtcagtatac  1620

V.1:  1621  cagaaaatgctcctgtaggcacttcagtgacacagctccatgccacagatgctgacatag  1680
            ||||||||||||||||||||||||||||||||||||||||||||||||||||||||||||
V.3:  1621  cagaaaatgctcctgtaggcacttcagtgacacagctccatgccacagatgctgacatag  1680

V.1:  1681  gtgaaaatgccaagatccacttctctttcagcaatctagtctccaacattgccaggagat  1740
            ||||||||||||||||||||||||||||||||||||||||||||||||||||||||||||
V.3:  1681  gtgaaaatgccaagatccacttctctttcagcaatctagtctccaacattgccaggagat  1740

V.1:  1741  tatttcacctcaatgccaccactggacttatcacaatcaaagaaccactggatagggaag  1800
            ||||||||||||||||||||||||||||||||||||||||||||||||||||||||||||
V.3:  1741  tatttcacctcaatgccaccactggacttatcacaatcaaagaaccactggatagggaag  1800

V.1:  1801  aaacaccaaaccacaagttactggttttggcaagtgatggtggattgatgccagcaagag  1860
            ||||||||||||||||||||||||||||||||||||||||||||||||||||||||||||
V.3:  1801  aaacaccaaaccacaagttactggttttggcaagtgatggtggattgatgccagcaagag  1860

V.1:  1861  caatggtgctggtaaatgttacagatgtcaatgataatgtcccatccattgacataagat  1920
            ||||||||||||||||||||||||||||||||||||||||||||||||||||||||||||
V.3:  1861  caatggtgctggtaaatgttacagatgtcaatgataatgtcccatccattgacataagat  1920

V.1:  1921  acatcgtcaatcctgtcaatgacacagttgttctttcagaaaatattccactcaacacca  1980
            ||||||||||||||||||||||||||||||||||||||||||||||||||||||||||||
V.3:  1921  acatcgtcaatcctgtcaatgacacagttgttctttcagaaaatattccactcaacacca  1980

V.1:  1981  aaattgctctcataactgtgacggataaggatgcggaccataatggcagggtgacatgct  2040
            ||||||||||||||||||||||||||||||||||||||||||||||||||||||||||||
V.3:  1981  aaattgctctcataactgtgacggataaggatgcggaccataatggcagggtgacatgct  2040

V.1:  2041  tcacagatcatgaaatccctttcagattaaggccagtattcagtaatcagttcctcctgg  2100
            ||||||||||||||||||||||||||||||||||||||||||||||||||||||||||||
V.3:  2041  tcacagatcatgaaatccctttcagattaaggccagtattcagtaatcagttcctcctgg  2100

V.1:  2101  agactgcagcatatcttgactatgagtccacaaaagaatatgccattaaattactggctg  2160
            ||||||||||||||||||||||||||||||||||||||||||||||||||||||||||||
V.3:  2101  agactgcagcatatcttgactatgagtccacaaaagaatatgccattaaattactggctg  2160

V.1:  2161  cagatgctggcaaacctcctttgaatcagtcagcaatgctcttcatcaaagtgaaagatg  2220
            ||||||||||||||||||||||||||||||||||||||||||||||||||||||||||||
V.3:  2161  cagatgctggcaaacctcctttgaatcagtcagcaatgctcttcatcaaagtgaaagatg  2220

V.1:  2221  aaaatgacaatgctccagttttcacccagtctttcgtaactgtttctattcctgagaata  2280
            ||||||||||||||||||||||||||||||||||||||||||||||||||||||||||||
V.3:  2221  aaaatgacaatgctccagttttcacccagtctttcgtaactgtttctattcctgagaata  2280

V.1:  2281  actctcctggcatccagttgacgaaagtaagtgcaatggatgcagacagtgggcctaatg  2340
            ||||||||||||||||||||||||||||||||||||||||||||||||||||||||||||
V.3:  2281  actctcctggcatccagttgacgaaagtaagtgcaatggatgcagacagtgggcctaatg  2340

V.1:  2341  ctaagatcaattacctgctaggccctgatgctccacctgaattcagcctggattgtcgta  2400
            ||||||||||||||||||||||||||||||||||||||||||||||||||||||||||||
V.3:  2341  ctaagatcaattacctgctaggccctgatgctccacctgaattcagcctggattgtcgta  2400

V.1:  2401  caggcatgctgactgtagtgaagaaactagatagagaaaagaggataaatatttattca  2460
            ||||||||||||||||||||||||||||||||||||||||||||||||||||||||||||
V.3:  2401  caggcatgctgactgtagtgaagaaactagatagagaaaagaggataaatatttattca  2460

V.1:  2461  caattctggcaaaagataacggggtaccacccttaaccagcaatgtcacagtctttgtaa  2520
            ||||||||||||||||||||||||||||||||||||||||||||||||||||||||||||
V.3:  2461  caattctggcaaaagataacggggtaccacccttaaccagcaatgtcacagtctttgtaa  2520

V.1:  2521  gcattattgatcagaatgacaatagcccagttttcactcacaatgaatacaacttctatg  2580
            ||||||||||||||||||||||||||||||||||||||||||||||||||||||||||||
V.3:  2521  gcattattgatcagaatgacaatagcccagttttcactcacaatgaatacaacttctatg  2580

V.1:  2581  tcccagaaaaccttccaaggcatggtacagtaggactaatcactgtaactgatcctgatt  2640
            ||||||||||||||||||||||||||||||||||||||||||||||||||||||||||||
V.3:  2581  tcccagaaaaccttccaaggcatggtacagtaggactaatcactgtaactgatcctgatt  2640
```

TABLE LIII(b)-continued

Nucleotide sequence alignment of 109P1D4 v.1 (SEQ ID NO: 244) and
109P1D4 v.3 (SEQ ID NO: 245) Score = 7456 bits (3878),
Expect = 0.0Identities = 3878/3878 (100%) Strand = Plus/Plus

```
V.1:  2641  atggagacaattctgcagttacgctctccattttagatgagaatgatgacttcaccattg  2700
            ||||||||||||||||||||||||||||||||||||||||||||||||||||||||||||
V.3:  2641  atggagacaattctgcagttacgctctccattttagatgagaatgatgacttcaccattg  2700

V.1:  2701  attcacaaactggtgtcatccgaccaaatatttcatttgatagagaaaaacaagaatctt  2760
            ||||||||||||||||||||||||||||||||||||||||||||||||||||||||||||
V.3:  2701  attcacaaactggtgtcatccgaccaaatatttcatttgatagagaaaaacaagaatctt  2760

V.1:  2761  acactttctatgtaaaggctgaggatggtggtagagtatcacgttcttcaagtgccaaag  2820
            ||||||||||||||||||||||||||||||||||||||||||||||||||||||||||||
V.3:  2761  acactttctatgtaaaggctgaggatggtggtagagtatcacgttcttcaagtgccaaag  2820

V.1:  2821  taaccataaatgtggttgatgtcaatgacaacaaaccagttttcattgtccctccttcca  2880
            ||||||||||||||||||||||||||||||||||||||||||||||||||||||||||||
V.3:  2821  taaccataaatgtggttgatgtcaatgacaacaaaccagttttcattgtccctccttcca  2880

V.1:  2881  actgttcttatgaattggttctaccgtccactaatccaggcacagtggtctttcaggtaa  2940
            ||||||||||||||||||||||||||||||||||||||||||||||||||||||||||||
V.3:  2881  actgttcttatgaattggttctaccgtccactaatccaggcacagtggtctttcaggtaa  2940

V.1:  2941  ttgctgttgacaatgacactggcatgaatgcagaggttcgttacagcattgtaggaggaa  3000
            ||||||||||||||||||||||||||||||||||||||||||||||||||||||||||||
V.3:  2941  ttgctgttgacaatgacactggcatgaatgcagaggttcgttacagcattgtaggaggaa  3000

V.1:  3001  acacaagagatctgtttgcaatcgaccaagaaacaggcaacataacattgatggagaaat  3060
            ||||||||||||||||||||||||||||||||||||||||||||||||||||||||||||
V.3:  3001  acacaagagatctgtttgcaatcgaccaagaaacaggcaacataacattgatggagaaat  3060

V.1:  3061  gtgatgttacagaccttggtttacacagagtgttggtcaaagctaatgacttaggacagc  3120
            ||||||||||||||||||||||||||||||||||||||||||||||||||||||||||||
V.3:  3061  gtgatgttacagaccttggtttacacagagtgttggtcaaagctaatgacttaggacagc  3120

V.1:  3121  ctgattctctcttcagtgttgtaattgtcaatctgttcgtgaatgagtcggtgaccaatg  3180
            ||||||||||||||||||||||||||||||||||||||||||||||||||||||||||||
V.3:  3121  ctgattctctcttcagtgttgtaattgtcaatctgttcgtgaatgagtcggtgaccaatg  3180

V.1:  3181  ctacactgattaatgaactggtgcgcaaaagcactgaagcaccagtgaccccaaatactg  3240
            ||||||||||||||||||||||||||||||||||||||||||||||||||||||||||||
V.3:  3181  ctacactgattaatgaactggtgcgcaaaagcactgaagcaccagtgaccccaaatactg  3240

V.1:  3241  agatagctgatgtatcctcaccaactagtgactatgtcaagatcctggttgcagctgttg  3300
            ||||||||||||||||||||||||||||||||||||||||||||||||||||||||||||
V.3:  3241  agatagctgatgtatcctcaccaactagtgactatgtcaagatcctggttgcagctgttg  3300

V.1:  3301  ctggcaccataactgtcgttgtagttattttcatcactgctgtagtaagatgtcgccagg  3360
            ||||||||||||||||||||||||||||||||||||||||||||||||||||||||||||
V.3:  3301  ctggcaccataactgtcgttgtagttattttcatcactgctgtagtaagatgtcgccagg  3360

V.1:  3361  caccacaccttaaggctgctcagaaaaacaagcagaattctgaatgggctaccccaaacc  3420
            ||||||||||||||||||||||||||||||||||||||||||||||||||||||||||||
V.3:  3361  caccacaccttaaggctgctcagaaaaacaagcagaattctgaatgggctaccccaaacc  3420

V.1:  3421  cagaaaacaggcagatgataatgatgaagaaaaagaaaaagaagaagaagcattcccta  3480
            ||||||||||||||||||||||||||||||||||||||||||||||||||||||||||||
V.3:  3421  cagaaaacaggcagatgataatgatgaagaaaaagaaaaagaagaagaagcattcccta  3480

V.1:  3481  agaacttgctgcttaattttgtcactattgaagaaactaaggcagatgatgttgacagtg  3540
            ||||||||||||||||||||||||||||||||||||||||||||||||||||||||||||
V.3:  3481  agaacttgctgcttaattttgtcactattgaagaaactaaggcagatgatgttgacagtg  3540

V.1:  3541  atggaaacagagtcacactagaccttcctattgatctagaagagcaaacaatgggaaagt  3600
            ||||||||||||||||||||||||||||||||||||||||||||||||||||||||||||
V.3:  3541  atggaaacagagtcacactagaccttcctattgatctagaagagcaaacaatgggaaagt  3600

V.1:  3601  acaattgggtaactacacctactactttcaagcccgacagccctgatttggcccgacact  3660
            ||||||||||||||||||||||||||||||||||||||||||||||||||||||||||||
V.3:  3601  acaattgggtaactacacctactactttcaagcccgacagccctgatttggcccgacact  3660

V.1:  3661  acaaatctgcctctccacagcctgccttccaaattcagcctgaaactcccctgaattcga  3720
            ||||||||||||||||||||||||||||||||||||||||||||||||||||||||||||
V.3:  3661  acaaatctgcctctccacagcctgccttccaaattcagcctgaaactcccctgaattcga  3720

V.1:  3721  agcaccacatcatccaagaactgcctctcgataacacctttgtggcctgtgactctatct  3780
            ||||||||||||||||||||||||||||||||||||||||||||||||||||||||||||
V.3:  3721  agcaccacatcatccaagaactgcctctcgataacacctttgtggcctgtgactctatct  3780
```

TABLE LIII(b)-continued

Nucleotide sequence alignment of 109P1D4 v.1 (SEQ ID NO: 244) and 109P1D4 v.3 (SEQ ID NO: 245) Score = 7456 bits (3878), Expect = 0.0 Identities = 3878/3878 (100%) Strand = Plus/Plus

```
V.1: 3781 ccaagtgttcctcaagcagttcagatccctacagcgtttctgactgtggctatccagtga 3840
           ||||||||||||||||||||||||||||||||||||||||||||||||||||||||||||
V.3: 3781 ccaagtgttcctcaagcagttcagatccctacagcgtttctgactgtggctatccagtga 3840

V.1: 3841 cgaccttcgaggtacctgtgtccgtacacaccagaccg 3878
           ||||||||||||||||||||||||||||||||||||||
V.3: 3841 cgaccttcgaggtacctgtgtccgtacacaccagaccg 3878
```

TABLE LIV(b)

Peptide sequences of protein coded by 109P1D4 v.3 (SEQ ID NO: 246)

```
MDLLSGTYIF AVLLACVVFH SGAQEKNYTI REEMPENVLI GDLLKDLNLS LIPNKSLTTA    60
MQFKLVYKTG DVPLIRIEED TGEIFTTGAR IDREKLCAGI PRDEHCFYEV EVATLPDETF   120
RLVKIRFLTE DINDNAPLFP ATVINISIPE NSAINSKYTL PAAVDPDVGI NGVQNYELIK   180
SQNIFGLDVI ETPEGDKMPQ LIVQKELDRE EKDTYVMKVK VEDGGFPQRS STAILQVSVT   240
DTNDNBPVFK ETEIEVSIPE NAPVGTSVTQ LHATDADIGE NAKIHFSFSN LVSNIARRLF   300
HLNATTGLIT IKEPLDREET PNHKLLVLAS DGGLMPAPAM VLVNVTDVND NVPSIDIRYI   360
VNPVNDTVVL SENIPLNTKI ALITVTDKDA DHNGRVTCFT DHEIPFRLRP VFSNQFLLET   420
AAYLDYESTK EYAIKLLAAD AGKPPLNQSA MLFIKVKDEN DNAPVFTQSF VTVSIPENNS   480
PGIQLTKVSA MDADSGPNAK INYLLGPDAP PEFSLDCRTG MLTVVKKLDR EKEDKYLFTI   540
LAKDNGVPPL TSNVTVFVSI IDQNDNSPVF THNEYNFYVP ENLPRHGTVG LITVTDPDYG   600
DNSAVTLSIL DENDDFTIDS QTGVIRPNIS FDREKQESYT FYVKAEDGGR VSRSSSAKVT   660
INVVDVNDNK PVFIVPPSNC SYELVLPSTN PGTVVFQVIA VDNDTGMNAE VRYSIVGGNT   720
RDLFAIDQET GNITLMEKCD VTDLGLHRVL VKANDLGQPD SLFSVVIVNL FVNESVTNAT   780
LINELVRKST EAPVTPNTEI ADVSSPTSDY VKILVAAVAG TITVVVVIFI TAVVRCRQAP   840
HLKAAQKNKQ NSEWATPNPE NRQMIMMKKK KKKKKHSPKN LLLNFVTIEE TKADDVDSDG   900
NRVTLDLPID LEEQTMGKYN WVTTPTTFKP DSPDLARHYK SASPQPAFQI QPETPLNSKH   960
HIIQELPLDN TFVACDSISK CSSSSSDPYS VSDCGYPVTT FEVPVSVHTR PPMKEVVRSC  1020
TPMKESTTME IWIHPQPQRK SEGKVAGKSQ RRVTFHLPEG SQESSSDGGL GDHDAGSLTS  1080
TSHGLPLGYP QEEYFDRATP SNRTEGDGNS DPESTFIPGL KKAAEITVQP TVEEASDNCT  1140
QECLIYGHSD ACWMPASLDH SSSSQAQASA LCHSPPLSQA STQHHSPRVT QTIALCHSPP  1200
VTQTIALCHS PPPIQVSALH HSPPLVQATA LHHSPPSAQA SALCYSPPLA QAAAISHSSP  1260
LPQVIALHRS QAQSSVSLQQ GWVQGADGLC SVDQGVQGSA TSQFYTMSER LHPSDDSIKV  1320
IPLTTFTPRQ QARPSRGDSP IMEEHPL                                     1347
```

TABLE LV(b)

Amino acid sequence alignment of 109P1D4 v.1 (SEQ ID NO: 247) and 109P1D4 v.3 (SEQ ID NO: 248) Score = 2005 bits (5195), Expect = 0.0 Identities = 1011/1011 (100%), Positives = 1011/1011 (100%)

```
V.1   1 MDLLSGTYIFAVLLACVVFHSGAQEKNYTIREEMPENVLIGDLLKDLNLSLIPNKSLTTA   60
        MDLLSGTYIFAVLLACVVFHSGAQEKNYTIREEMPENVLIGDLLKDLNLSLIPNKSLTTA
V.3   1 MDLLSGTYIFAVLLACVVFHSGAQEKNYTIREEMPENVLIGDLLKDLNLSLIPNKSLTTA   60

V.1  61 MQFKLVYKTGDVPLIRIEEDTGEIFTTGARIDREKLCAGIPRDEHCFYEVEVAILPDEIF  120
        MQFKLVYKTGDVPLIRIEEDTGEIFTTGARIDREKLCAGIPRDEHCFYEVEVAILPDEIF
```

TABLE LV(b)-continued

Amino acid sequence alignment of 109P1D4 v.1 (SEQ ID NO: 247) and
109P1D4 v.3 (SEQ ID NO: 248) Score = 2005 bits (5195), Expect =
0.0Identities = 1011/1011 (100%), Positives = 1011/1011 (100%)

```
V.3  61 MQFKLVYKTGDVPLIRIEEDTGEIFTTGARIDREKLCAGIPRDEHCFYEVEVAILPDEIF 120

V.1 121 RLVKIRFLIEDINDNAPLFPATVINISIPENSAINSKYTLPAAVDPDVGINGVQNYELIK 180
        RLVKIRFLIEDINDNAPLFPATVINISIPENSAINSKYTLPAAVDPDVGINGVQNYELIK
V.3 121 RLVKIRFLIEDINDNAPLFPATVINISIPENSAINSKYTLPAAVDPDVGINGVQNYELIK 180

V.1 181 SQNIFGLDVIETPEGDKMPQLIVQKELDREEKDTYVMKVKVEDGGFPQRSSTAILQVSVT 240
        SQNIFGLDVIETPEGDKMPQLIVQKELDREEKDTYVMKVKVEDGGFPQRSSTAILQVSVT
V.3 181 SQNIFGLDVIETPEGDKMPQLIVQKELDREEKDTYVMKVKVEDGGFPQRSSTAILQVSVT 240

V.1 241 DTNDNHPVFKETEIEVSIPENAPVGTSVTQLHATDADIGENAKIHFSFSNLVSNIARRLF 300
        DTNDNHPVFKETEIEVSIPENAPVGTSVTQLHATDADIGENAKIHFSFSNLVSNIARRLF
V.3 241 DTNDNHPVFKETEIEVSIPENAPVGTSVTQLHATDADIGENAKIHFSFSNLVSNIARRLF 300

V.1 301 HLNATTGLITIKEPLDREETPNHKLLVLASDGGLMPARANVLVNVTDVNDNVPSIDIRYI 360
        HLNATTGLITIKEPLDREETPNHKLLVLASDGCLMPARANVLVNVTDVNDNVPSIDIRYI
V.3 301 HLNATTGLITIKEPLDREETPNHKLLVLASDGGLMPARAMVLVNVTDVNDNVPSIDIRYI 360

V.1 361 VNPVNDTVVLSENIPLNTKIALITVTDKDADHNGRVTCFTDHEIPFRLRPVFSNQFLLET 420
        VNPVNDTVVLSENIPLNTKIALITVTDKDADHNGRVTCFTDHEIPFRLRPVFSNQFLLET
V.3 361 VNPVNDTVVLSENIPLNTKIALITVTDKDADHNGRVTCFTDHEIPFRLRPVFSNQFLLET 420

V.1 421 AAYLDYESTKEYAIKLLAADAGKPPLNQSAMLFIKVKDENDNAPVFTQSFVTVSIPENNS 480
        AAYLDYESTKEYAIKLLAADAGKPPLNQSANLFIKVKDENDNAPVFTQSFVTVSIPENNS
V.3 421 AAYLDYESTKEYAIKLLAADAGKPPLNQSANLFIKVKDENDNAPVFTQSFVTVSIPENNS 480

V.1 481 PGIQLTKVSAMDADSGPNAKINYLLGPDAPPEFSLDCRTGMLTVVKKLDREKEDKYLFTI 540
        PGIQLTKVSAMDADSGPNAKINYLLGPDAPPEFSLDCRTGMLTVVKKLDREKEDKYLFTI
V.3 481 PGIQLTKVSANDADSGPNAKINYLLGPDAPPEFSLDCRTGMLTVVKKLDREKEDKYLFTI 540

V.1 541 LAKDNGVPPLTSNVTVFVSIIDQNDNSPVFTHNEYNFYVPENLPRHGTVGLITVTDPDYG 600
        LAKDNGVPPLTSNVTVFVSIIDQNDNSPVFTHNEYNFYVPENLPRHGTVGLITVTDPDYG
V.3 541 LAKDNGVPPLTSNVTVFVSIIDONDNSPVFTHNEYNFYVPENLPRHGTVGLITVTDPDYG 600

V.1 601 DNSAVTLSILDENDDFTIDSQTGVIRPNISFDREKQESYTFYVKAEDGGRVSRSSSAKVT 660
        DNSAVTLSILDENDDFTIDSQTGVIRPNISFDREKQESYTFYVKAEDGGRVSRSSSAKVT
V.3 601 DNSAVTLSILDENDDFTIDSQTGVIRPNISFDREKQESYTFYVKAEDGGRVSRSSSAKVT 660

V.1 661 INVVDVNDNKPVFIVPPSNCSYELVLPSTNPGTVVFQVIAVDNDTGMNAEVRYSIVGGNT 720
        INVVDVNDNKPVFIVPPSNCSYELVLPSTNPGTVVFQVIAVDNDTGMNAEVRYSIVGGNT
V.3 661 INVVDVNDNKPVFIVPPSNCSYELVLPSTNPGTVVFQVIAVDNDTGMNAEVRYSIVGGNT 720

V.1 721 RDLFAIDQETGNITLMEKCDVTDLGLHRVLVKANDLGQPDSLFSVVIVNLFVNESVTNAT 780
        RDLFAIDQETGNITLMEKCDVTDLGLHRVLVKANDLGQPDSLFSVVIVNLFVNESVTNAT
V.3 721 RDLFAIDQETGNITLMEKCDVTDLGLHRVLVKANDLGQPDSLFSVVIVNLFVNESVTNAT 780

V.1 781 LINELVRKSTEAPVTPNTEIADVSSPTSDYVKILVAAVAGTITVVVVIFITAVVRCRQAP 840
        LINELVRKSTEAPVTPNTEIADVSSPTSDYVKILVAAVAGTITVVVVIFITAVVRCRQAP
V.3 781 LINELVRKSTEAPVTPNTEIADVSSPTSDYVKILVAAVAGTITVVVVIFITAVVRCRQAP 840

V.1 841 HLKAAQKNKQNSEWATPNPENRQMIMMKKKKKKKKHSPKNLLLNFVTIEETKADDVDSDG 900
```

TABLE LII(c)

Nucleotide sequence of transcript variant 109P1D4 v.4 (SEQ ID NO: 249)

```
ctggtggtcc agtacctcca aagatatgga atacactcct gaaatatcct gaaaactttt    60
ttttttcaga atcctttaat aagcagttat gtcaatctga aagttgctta cttgtacttt   120
atattaatag ctattcttgt ttttcttatc caaagaaaaa tcctctaatc cccttttcac   180
atgatagttg ttaccatgtt taggcattag tcacatcaac ccctctcctc tcccaaactt   240
ctcttcttca aatcaaactt tattagtccc tcctttataa tgattccttg cctcgtttta   300
tccagatcaa ttttttttca ctttgatgcc cagagctgaa gaaatggact actgtataaa   360
ttattcattg ccaagagaat aattgcattt taaacccata ttataacaaa gaataatgat   420
tatattttgt gatttgtaac aaatacccct tattttccct taactattga attaaatatt   480
ttaattattt gtattctctt taactatctt ggtatattaa agtattatct tttatatatt   540
```

TABLE LII(c)-continued

Nucleotide sequence of transcript variant 109P1D4 v.4 (SEQ ID NO: 249)

| | | | | |
|---|---|---|---|---|
| tatcaatggt | ggacactttt | ataggtactc | tgtgtcattt | ttgatactgt | aggtatctta | 600 |
| tttcatttat | ctttattctt | aatgtacgaa | ttcataatat | ttgattcaga | acaaatttat | 660 |
| cactaattaa | cagagtgtca | attatgctaa | catctcattt | actgatttta | atttaaaaca | 720 |
| gtttttgtta | acatgcatgt | ttaggggttgg | cttcttaata | atttcttctt | cctcttctct | 780 |
| ctctcctctt | cttttggtca | gtgttgtgcg | ggttaataca | acaaactgta | acaagtgtac | 840 |
| ctggtatgga | cttgttgtcc | gggacgtaca | ttttcgcggt | cctgctagca | tgcgtggtgt | 900 |
| tccactctgg | cgcccaggag | aaaaactaca | ccatccgaga | agaaatgcca | gaaaacgtcc | 960 |
| tgataggcga | cttgttgaaa | gaccttaact | tgtcgctgat | tccaaacaag | tccttgacaa | 1020 |
| ctgctatgca | gttcaagcta | gtgtacaaga | ccggagatgt | gccactgatt | cgaattgaag | 1080 |
| aggatactgg | tgagatcttc | actactggcg | ctcgcattga | tcgtgagaaa | ttatgtgctg | 1140 |
| gtatcccaag | ggatgagcat | tgcttttatg | aagtggaggt | tgccattttg | ccggatgaaa | 1200 |
| tatttagact | ggttaagata | cgttttctga | tagaagatat | aaatgataat | gcaccattgt | 1260 |
| tcccagcaac | agttatcaac | atatcaattc | cagagaactc | ggctataaac | tctaaatata | 1320 |
| ctctcccagc | ggctgttgat | cctgacgtag | gaataaacgg | agttcaaaac | tacgaactaa | 1380 |
| ttaagagtca | aaacattttt | ggcctcgatg | tcattgaaac | accagaagga | gacaagatgc | 1440 |
| cacaactgat | tgttcaaaag | gagttagata | gggaagagaa | ggatacctac | gtgatgaaag | 1500 |
| taaaggttga | agatggtggc | tttcctcaaa | gatccagtac | tgctattttg | caagtgagtg | 1560 |
| ttactgatac | aaatgacaac | cacccagtct | ttaaggagac | agagattgaa | gtcagtatac | 1620 |
| cagaaaatgc | tcctgtaggc | acttcagtga | cacagctcca | tgccacagat | gctgacatag | 1680 |
| gtgaaaatgc | caagatccac | ttctctttca | gcaatctagt | ctccaacatt | gccaggagat | 1740 |
| tatttcacct | caatgccacc | actggactta | tcacaatcaa | agaaccactg | atagggaag | 1800 |
| aaacaccaaa | ccacaagtta | ctggttttgg | caagtgatgg | tggattgatg | ccagcaagag | 1860 |
| caatggtgct | ggtaaatgtt | acagatgtca | atgataatgt | cccatccatt | gacataagat | 1920 |
| acatcgtcaa | tcctgtcaat | gacacagttg | ttctttcaga | aaatattcca | ctcaacacca | 1980 |
| aaattgctct | cataactgtg | acggataagg | atgcggacca | taatggcagg | gtgacatgct | 2040 |
| tcacagatca | tgaaatccct | ttcagattaa | ggccagtatt | cagtaatcag | ttcctcctgg | 2100 |
| agactgcagc | atatcttgac | tatgagtcca | caaaagaata | tgccattaaa | ttactggctg | 2160 |
| cagatgctgg | caaacctcct | ttgaatcagt | cagcaatgct | cttcatcaaa | gtgaaagatg | 2220 |
| aaaatgacaa | tgctccagtt | ttcacccagt | ctttcgtaac | tgtttctatt | cctgagaata | 2280 |
| actctcctgg | catccagttg | acgaaagtaa | gtgcaatgga | tgcagacagt | gggcctaatg | 2340 |
| ctaagatcaa | ttacctgcta | ggccctgatg | ctccacctga | attcagcctg | gattgtcgta | 2400 |
| caggcatgct | gactgtagtg | aagaaactag | atagagaaaa | agaggataaa | tatttattca | 2460 |
| caattctggc | aaaagataac | gggtaccac | ccttaaccag | caatgtcaca | gtctttgtaa | 2520 |
| gcattattga | tcagaatgac | aatagcccag | ttttcactca | caatgaatac | aacttctatg | 2580 |
| tcccagaaaa | ccttccaagg | catggtacag | taggactaat | cactgtaact | gatcctgatt | 2640 |
| atggagacaa | ttctgcagtt | acgctctcca | ttttagtgga | gaatgatgac | ttcaccattg | 2700 |
| attcacaaac | tggtgtcatc | cgaccaaata | tttcatttga | tagagaaaaa | caagaatctt | 2760 |
| acactttcta | tgtaaaggct | gaggatggtg | gtagagtatc | acgttcttca | agtgccaaag | 2820 |
| taaccataaa | tgtggttgat | gtcaatgaca | acaaaccagt | tttcattgtc | cctccttcca | 2880 |

TABLE LII(c)-continued

Nucleotide sequence of transcript variant 109P1D4 v.4 (SEQ ID NO: 249)

```
actgttctta tgaattggtt ctaccgtcca ctaatccagg cacagtggtc tttcaggtaa   2940
ttgctgttga caatgacact ggcatgaatg cagaggttcg ttacagcatt gtaggaggaa   3000
acacaagaga tctgtttgca atcgaccaag aaacaggcaa cataacattg atggagaaat   3060
gtgatgttac agaccttggt ttacacagag tgttggtcaa agctaatgac ttaggacagc   3120
ctgattctct cttcagtgtt gtaattgtca atctgttcgt gaatgagtcg gtgaccaatg   3180
ctacactgat taatgaactg gtgcgcaaaa gcactgaagc accagtgacc ccaaatactg   3240
agatagctga tgtatcctca ccaactagtg actatgtcaa gatcctggtt gcagctgttg   3300
ctggcaccat aactgtcgtt gtagttattt tcatcactgc tgtagtaaga tgtcgccagg   3360
caccacacct taaggctgct cagaaaaaca agcagaattc tgaatgggct accccaaacc   3420
cagaaaacag gcagatgata atgatgaaga aaagaaaaa gaagaagaag cattccccta   3480
agaacttgct gcttaatttt gtcactattg aagaaactaa ggcagatgat gttgacagtg   3540
atggaaacag agtcacacta gaccttccta ttgatctaga agagcaaaca atgggaaagt   3600
acaattgggt aactacacct actactttca agcccgacag ccctgatttg gcccgacact   3660
acaaatctgc ctctccacag cctgccttcc aaattcagcc tgaaactccc ctgaattcga   3720
agcaccacat catccaagaa ctgcctctcg ataacacctt tgtggcctgt gactctatct   3780
ccaagtgttc ctcaagcagt tcagatccct acagcgtttc tgactgtggc tatccagtga   3840
cgaccttcga ggtacctgtg tccgtacaca ccagaccgcc aatgaaggag gttgtgcgat   3900
cttgcacccc catgaaagag tctacaacta tggagatctg gattcatccc caaccacagt   3960
cccagcggcg tgtcacattt cacctgccag aaggctctca ggaaagcagc agtgatggtg   4020
gactgggaga ccatgatgca ggcagcctta ccagcacatc tcatggcctg cccettggct   4080
atcctcagga ggagtacttt gatcgtgcta cacccagcaa tcgcactgaa ggggatggca   4140
actccgatcc tgaatctact ttcatacctg gactaaagaa agctgcagaa ataactgttc   4200
aaccaactgt ggaagaggcc tctgacaact gcactcaaga atgtctcatc tatggccatt   4260
ctgatgcctg ctggatgccg gcatctctgg atcattccag ctcttcgcaa gcacaggcct   4320
ctgctctatg ccacagccca ccactgtcac aggcctctac tcagcaccac agcccacgag   4380
tgacacagac cattgctctc tgccacagcc ctccagtgac acagaccatc gcattgtgcc   4440
acagcccacc accgatacag gtgtctgctc tccaccacag tcctcctcta gtgcaggcta   4500
ctgcacttca ccacagccca ccatcagcac aggcctcagc cctctgctac agccctcctt   4560
tagcacaggc tgctgcaatc agccacagct ctcctctgcc acaggttatt gccctccatc   4620
gtagtcaggc ccaatcatca gtcagtttgc agcaaggttg ggtgcaaggt gctgatgggc   4680
tatgctctgt tgatcaggga gtgcaaggta gtgcaacatc tcagttttac accatgtctg   4740
aaagacttca tcccagtgat gattcaatta agtcattcc tttgacaacc ttcactccac   4800
gccaacaggc cagaccgtcc agaggtgatt cccccattat ggaagaacat cccttgtaaa   4860
gctaaaatag ttacttcaaa ttttcagaaa agatgtatat agtcaaaatt taagatacaa   4920
ttccaatgag tattctgatt atcagatttg taaataacta tgtaaataga aacagatacc   4980
agaataaatc tacagctaga ccccttagtca atagttaacc aaaaaattgc aatttgttta   5040
attcagaatg tgtatttaaa agaaaagga atttaacaat ttgcatcccc ttgtacagta   5100
aggcttatca tgacagagcg cactatttct gatgtacagt atttttttgtt gtttttatca   5160
tcatgtgcaa tattactgat ttgtttccat gctgattgtg tggaaccagt atgtagcaaa   5220
```

TABLE LII(c)-continued

Nucleotide sequence of transcript variant 109P1D4 v.4 (SEQ ID NO: 249)

```
tggaaagcct agaaatatct tattttctaa gtttacccttt agtttaccta aacttttgtt    5280
cagataacgt taaaaggtat acgtactcta gccttttttt gggctttctt tttgattttt    5340
gtttgttgtt ttcagttttt ttgttgttgt tagtgagtct cccttcaaaa tacgcagtag    5400
gtagtgtaaa tactgcttgt ttgtgtctct ctgctgtcat gttttctacc ttattccaat    5460
actatattgt tgataaaatt tgtatataca ttttcaataa agaatatgta taaactgtac    5520
agatctagat ctacaaccta tttctctact ctttagtaga gttcgagaca cagaagtgca    5580
ataactgccc taattaagca actatttgtt aaaaagggcc tcttttttact ttaatagttt    5640
agtgtaaagt acatcagaaa taaagctgta tctgccattt taagcctgta gtccattatt    5700
acttgggtct ttacttctgg gaatttgtat gtaacagcct agaaaattaa aaggaggtgg    5760
atgcatccaa agcacgagtc acttaaaata tcgacggtaa actactattt tgtagagaaa    5820
ctcaggaaga tttaaatgtt gatttgacag ctcaataggc tgttaccaaa gggtgttcag    5880
taaaaataac aaatacatgt aactgtagat aaaaccatat actaaatcta taagactaag    5940
ggattttttgt tattctagct caacttactg aagaaaaacca ctaataacaa caagaatatc    6000
aggaaggaac ttttcaagaa atgtaattat aaatctacat caaacagaat tttaaggaaa    6060
aatgcagagg gagaaataag gcacatgact gcttcttgca gtcaacaaga aataccaata    6120
acacacacag aacaaaaacc atcaaaatct catatatgaa ataaaatata ttcttctaag    6180
caaagaaaca gtactattca tagaaaacat tagttttctt ctgttgtctg ttatttcctt    6240
cttgtatcct cttaactggc cattatcttg tatgtgcaca ttttataaat gtacagaaac    6300
atcaccaact taatttttctt ccatagcaaa actgagaaaa taccttgttt cagtataaca    6360
ctaaaccaag agacaattga tgtttaatgg gggcggttgg ggtgggggggg ggagtcaata    6420
tctcctattg attaacttag acatagattt tgtaatgtat aacttgatat ttaatttatg    6480
attaaactgt gtgtaaattt tgtaacataa actgtggtaa ttgcataatt tcattggtga    6540
ggatttccac tgaatattga gaaagttttct tttcatgtgc ccagcaggtt aagtagcgtt    6600
ttcagaatat acattattcc catccattgt aaagttcctt aagtcatatt tgactgggcg    6660
tgcagaataa cttcttaact tttaactatc agagtttgat taataaaatt aattaatgtt    6720
ttttctcctt cgtgttgtta atgttccaag ggatttggag catactggtt ttccaggtgc    6780
atgtgaatcc cgaaggactg atgatatttg aatgtttatt aaattattat catacaaatg    6840
tgttgatatt gtggctattg ttgatgttga aaattttaaa cttggggaag attaagaaaa    6900
gaaccaatag tgacaaaaat cagtgcttcc agtagatttt agaacattct ttgcctcaaa    6960
aaacctgcaa agatgatgtg agatttttc ttgtgtttta attattttca catttctct      7020
ctgcaaaact ttagttttct gatgatctac acacacacac acacacacac gtgcacacac    7080
acacacattt aaatgatata aaagaagag gttgaaagat tattaaataa cttatcaggc     7140
atctcaatgg ttactatcta tgttagtgaa aatcaaatag gactcaaagt tggatatttg    7200
ggattttttct tctgacagta taatttattg agttactagg gaggttctta aatcctcata   7260
tctggaaact tgtgacgttt tgacacctttt cctatagatg atataggaat gaaccaatac    7320
gcttttatta ccctttctaa ctctgatttt ataatcagac ttagattgtg tttagaatat    7380
taaatgactg ggcaccctct tcttggtttt taccagagag gctttgaatg aagcaggct     7440
gagagtagcc aaagaggcaa gggggtattag cccagttatt ctcccctatg ccttccttct   7500
ctttctaagc gtccactagg tctggccttg gaaacctgtt acttctaggg cttcagatct    7560
```

TABLE LII(c)-continued

Nucleotide sequence of transcript variant 109P1D4 v.4 (SEQ ID NO: 249)

```
gatgatatct tttcatcac attacaagtt atttctctga ctgaatagac agtggtatag    7620
gttgacacag cacacaagtg gctattgtga tgtatgatgt atgtagtcct acaactgcaa    7680
aacgtcttac tgaaccaaca atcaaaaaat ggttctgttt taaaaaggat tttgtttgat    7740
ttgaaattaa aacttcaagc tgaatgactt atatgagaat aatacgttca atcaaagtag    7800
ttattctatt ttgtgtccat attccattag attgtgatta ttaattttct agctatggta    7860
ttactatatc acacttgtga gtatgtattc aaatactaag tatcttatat gctacgtgca    7920
tacacattct tttcttaaac tttacctgtg ttttaactaa tattgtgtca gtgtattaaa    7980
aattagcttt tacatatgat atctacaatg taataaattt agagagtaat tttgtgtatt    8040
cttatttact taacatttta cttttaatta tgtaaatttg gttagaaaat aataataaat    8100
ggttagtgct attgtgtaat ggtagcagtt acaaagagcc tctgccttcc caaactaata    8160
tttatcacac atggtcatta aatgggaaaa aaatagacta aacaaatcac aaattgttca    8220
gttcttaaaa tgtaattatg tcacacacac aaaaaatcct tttcaatcct gagaaaatta    8280
aaggcgtttt actcacatgg ctatttcaac attagttttt tttgtttgtt tcttttttcat   8340
ggtattactg aaggtgtgta tactccctaa tacacattta tgaaaatcta cttgtttagg    8400
cttttattta tactcttctg atttatattt tttattataa ttattatttc ttatctttct    8460
tcttttatat tttttggaaa ccaaatttat agttagttta ggtaaacttt ttattatgac    8520
cattagaaac tattttgaat gcttccaact ggctcaattg gccgggaaaa catgggagca    8580
agagaagctg aaatatattt ctgcaagaac cttctatat tatgtgccaa ttaccacacc     8640
agatcaattt tatgcagagg ccttaaaata ttctttcaca gtagcttttct tacactaacc   8700
gtcatgtgct tttagtaaat atgattttta aaagcagttc aagttgacaa cagcagaaac    8760
agtaacaaaa aaatctgctc agaaaaatgt atgtgcacaa ataaaaaaaa ttaatggcaa    8820
ttgtttagtg attgtaagtg atactttta aagagtaaac tgtgtgaaat ttatactatc     8880
cctgcttaaa atattaagat ttttatgaaa tatgtattta tgtttgtatt gtgggaagat    8940
tcctcctctg tgatatcata cagcatctga aagtgaacag tatcccaaag cagttccaac    9000
catgctttgg aagtaagaag gttgactatt gtatggccaa ggatggcagt atgtaatcca    9060
gaagcaaact tgtattaatt gttctatttc aggttctgta ttgcatgttt tcttattaat    9120
atatattaat aaaagttatg agaaat                                          9146
```

TABLE LIII(c)

Nucleotide sequence alignment of 109P1D4 v.1 (SEQ ID NO: 250) and
109P1D4 v.4 (SEQ ID NO: 251) Score = 7456 bits (3878),
Expect = 0.0 Identities = 3878/3878 (100%) Strand = Plus/Plus

```
V.1:    1  ctggtggtccagtacctccaaagatatggaatacactcctgaaatatcctgaaaacttttt   60
           ||||||||||||||||||||||||||||||||||||||||||||||||||||||||||||
V.4:    1  ctggtggtccagtacctccaaagatatggaatacactcctgaaatatcctgaaaacttttt   60

V.1:   61  tttttcagaatcctttaataagcagttatgtcaatctgaaagttgcttacttgtactttt   120
           ||||||||||||||||||||||||||||||||||||||||||||||||||||||||||||
V.4:   61  tttttcagaatcctttaataagcagttatgtcaatctgaaagttgcttacttgtactttt   120

V.1:  121  atattaatagctattcttgttttcttatccaaagaaaaatcctctaatccccttttcac    180
           ||||||||||||||||||||||||||||||||||||||||||||||||||||||||||||
V.4:  121  atattaatagctattcttgttttcttatccaaagaaaaatcctctaatccccttttcac    180
```

TABLE LIII(c)-continued

Nucleotide sequence alignment of 109P1D4 v.1 (SEQ ID NO: 250) and 109P1D4 v.4 (SEQ ID NO: 251) Score = 7456 bits (3878), Expect = 0.0 Identities = 3878/3878 (100%) Strand = Plus/Plus

```
V.1:   181  atgatagttgttaccatgtttaggcattagtcacatcaacccctctcctctcccaaactt  240
             ||||||||||||||||||||||||||||||||||||||||||||||||||||||||||||
V.4:   181  atgatagttgttaccatgtttaggcattagtcacatcaacccctctcctctcccaaactt  240

V.1:   241  ctcttcttcaaatcaaactttattagtccctcctttataatgattccttgcctcgtttta  300
             ||||||||||||||||||||||||||||||||||||||||||||||||||||||||||||
V.4:   241  ctcttcttcaaatcaaactttattagtccctcctttataatgattccttgcctcgtttta  300

V.1:   301  tccagatcaattttttttcactttgatgcccagagctgaagaaatggactactgtataaa  360
             ||||||||||||||||||||||||||||||||||||||||||||||||||||||||||||
V.4:   301  tccagatcaattttttttcactttgatgcccagagctgaagaaatggactactgtataaa  360

V.1:   361  ttattcattgccaagagaataattgcattttaaacccatattataacaaagaataatgat  420
             ||||||||||||||||||||||||||||||||||||||||||||||||||||||||||||
V.4:   361  ttattcattgccaagagaataattgcattttaaacccatattataacaaagaataatgat  420

V.1:   421  tatattttgtgatttgtaacaaatacccctttattttcccttaactattgaattaaatatt  480
             ||||||||||||||||||||||||||||||||||||||||||||||||||||||||||||
V.4:   421  tatattttgtgatttgtaacaaatacccctttattttcccttaactattgaattaaatatt  480

V.1:   481  ttaattatttgtattctctttaactatcttggtatattaaagtattatcttttatatatt  540
             ||||||||||||||||||||||||||||||||||||||||||||||||||||||||||||
V.4:   481  ttaattatttgtattctctttaactatcttggtatattaaagtattatcttttatatatt  540

V.1:   541  tatcaatggtggacacttttataggtactctgtgtcattttgatactgtaggtatctta  600
             ||||||||||||||||||||||||||||||||||||||||||||||||||||||||||||
V.4:   541  tatcaatggtggacacttttataggtactctgtgtcattttgatactgtaggtatctta  600

V.1:   601  tttcatttatctttattcttaatgtacgaattcataatatttgattcagaacaaatttat  660
             ||||||||||||||||||||||||||||||||||||||||||||||||||||||||||||
V.4:   601  tttcatttatctttattcttaatgtacgaattcataatatttgattcagaacaaatttat  660

V.1:   661  cactaattaacagagtgtcaattatgctaacatctcatttactgattttaatttaaaaca  720
             ||||||||||||||||||||||||||||||||||||||||||||||||||||||||||||
V.4:   661  cactaattaacagagtgtcaattatgctaacatctcatttactgattttaatttaaaaca  720

V.1:   721  gtttttgttaacatgcatgtttagggttggcttcttaataatttcttcttcctcttctct  780
             ||||||||||||||||||||||||||||||||||||||||||||||||||||||||||||
V.4:   721  gtttttgttaacatgcatgtttagggttggcttcttaataatttcttcttcctcttctct  780

V.1:   781  ctctcctcttcttttggtcagtgttgtgcgggttaatacaacaaactgtaacaagtgtac  840
             ||||||||||||||||||||||||||||||||||||||||||||||||||||||||||||
V.4:   781  ctctcctcttcttttggtcagtgttgtgcgggttaatacaacaaactgtaacaagtgtac  840

V.1:   841  ctggtatggacttgttgtccgggacgtacattttcgcggtcctgctagcatgcgtggtgt  900
             ||||||||||||||||||||||||||||||||||||||||||||||||||||||||||||
V.4:   841  ctggtatggacttgttgtccgggacgtacattttcgcggtcctgctagcatgcgtggtgt  900

V.1:   901  tccactctggcgcccaggagaaaaactacaccatccgagaagaaatgccagaaaacgtcc  960
             ||||||||||||||||||||||||||||||||||||||||||||||||||||||||||||
V.4:   901  tccactctggcgcccaggagaaaaactacaccatccgagaagaaatgccagaaaacgtcc  960

V.1:   961  tgataggcgacttgttgaaagaccttaacttgtcgctgattccaaacaagtccttgacaa  1020
             ||||||||||||||||||||||||||||||||||||||||||||||||||||||||||||
V.4:   961  tgataggcgacttgttgaaagaccttaacttgtcgctgattccaaacaagtccttgacaa  1020

V.1:  1021  ctgctatgcagttcaagctagtgtacaagaccggagatgtgccactgattcgaattgaag  1080
             ||||||||||||||||||||||||||||||||||||||||||||||||||||||||||||
V.4:  1021  ctgctatgcagttcaagctagtgtacaagaccggagatgtgccactgattcgaattgaag  1080

V.1:  1081  aggatactggtgagatcttcactactggcgctcgcattgatcgtgagaaattatgtgctg  1140
             ||||||||||||||||||||||||||||||||||||||||||||||||||||||||||||
V.4:  1081  aggatactggtgagatcttcactactggcgctcgcattgatcgtgagaaattatgtgctg  1140

V.1:  1141  gtatcccaagggatgagcattgcttttatgaagtggaggttgccatttttgccggatgaaa  1200
             ||||||||||||||||||||||||||||||||||||||||||||||||||||||||||||
V.4:  1141  gtatcccaagggatgagcattgcttttatgaagtggaggttgccatttttgccggatgaaa  1200

V.1:  1201  tatttagactggttaagatacgttttctgatagaagatataaatgataatgcaccattgt  1260
             ||||||||||||||||||||||||||||||||||||||||||||||||||||||||||||
V.4:  1201  tatttagactggttaagatacgttttctgatagaagatataaatgataatgcaccattgt  1260
```

TABLE LIII(c)-continued

Nucleotide sequence alignment of 109P1D4 v.1 (SEQ ID NO: 250) and 109P1D4 v.4 (SEQ ID NO: 251) Score = 7456 bits (3878), Expect = 0.0 Identities = 3878/3878 (100%) Strand = Plus/Plus

```
V.1:  1261  tcccagcaacagttatcaacatatcaattccagagaactcggctataaactctaaatata  1320
            ||||||||||||||||||||||||||||||||||||||||||||||||||||||||||||
V.4:  1261  tcccagcaacagttatcaacatatcaattccagagaactcggctataaactctaaatata  1320

V.1:  1321  ctctcccagcggctgttgatcctgacgtaggaataaacggagttcaaaactacgaactaa  1380
            ||||||||||||||||||||||||||||||||||||||||||||||||||||||||||||
V.4:  1321  ctctcccagcggctgttgatcctgacgtaggaataaacggagttcaaaactacgaactaa  1380

V.1:  1381  ttaagagtcaaaacattttggcctcgatgtcattgaaacaccagaaggagacaagatgc   1440
            ||||||||||||||||||||||||||||||||||||||||||||||||||||||||||||
V.4:  1381  ttaagagtcaaaacattttggcctcgatgtcattgaaacaccagaaggagacaagatgc   1440

V.1:  1441  cacaactgattgttcaaaaggagttagatagggaagagaaggatacctacgtgatgaaag  1500
            ||||||||||||||||||||||||||||||||||||||||||||||||||||||||||||
V.4:  1441  cacaactgattgttcaaaaggagttagatagggaagagaaggatacctacgtgatgaaag  1500

V.1:  1501  taaaggttgaagatggtggctttcctcaaagatccagtactgctattttgcaagtgagtg  1560
            ||||||||||||||||||||||||||||||||||||||||||||||||||||||||||||
V.4:  1501  taaaggttgaagatggtggctttcctcaaagatccagtactgctattttgcaagtgagtg  1560

V.1:  1561  ttactgatacaaatgacaaccacccagtctttaaggagacagagattgaagtcagtatac  1620
            ||||||||||||||||||||||||||||||||||||||||||||||||||||||||||||
V.4:  1561  ttactgatacaaatgacaaccacccagtctttaaggagacagagattgaagtcagtatac  1620

V.1:  1621  cagaaaatgctcctgtaggcacttcagtgacacagctccatgccacagatgctgacatag  1680
            ||||||||||||||||||||||||||||||||||||||||||||||||||||||||||||
V.4:  1621  cagaaaatgctcctgtaggcacttcagtgacacagctccatgccacagatgctgacatag  1680

V.1:  1681  gtgaaaatgccaagatccacttctctttcagcaatctagtctccaacattgccaggagat  1740
            ||||||||||||||||||||||||||||||||||||||||||||||||||||||||||||
V.4:  1681  gtgaaaatgccaagatccacttctctttcagcaatctagtctccaacattgccaggagat  1740

V.1:  1741  tatttcacctcaatgccaccactggacttatcacaatcaaagaaccactggatagggaag  1800
            ||||||||||||||||||||||||||||||||||||||||||||||||||||||||||||
V.4:  1741  tatttcacctcaatgccaccactggacttatcacaatcaaagaaccactggatagggaag  1800

V.1:  1801  aaacaccaaaccacaagttactggttttggcaagtgatggtggattgatgccagcaagag  1860
            ||||||||||||||||||||||||||||||||||||||||||||||||||||||||||||
V.4:  1801  aaacaccaaaccacaagttactggttttggcaagtgatggtggattgatgccagcaagag  1860

V.1:  1861  caatggtgctggtaaatgttacagatgtcaatgataatgtcccatccattgacataagat  1920
            ||||||||||||||||||||||||||||||||||||||||||||||||||||||||||||
V.4:  1861  caatggtgctggtaaatgttacagatgtcaatgataatgtcccatccattgacataagat  1920

V.1:  1921  acatcgtcaatcctgtcaatgacacagttgttctttcagaaaatattccactcaacacca  1980
            ||||||||||||||||||||||||||||||||||||||||||||||||||||||||||||
V.4:  1921  acatcgtcaatcctgtcaatgacacagttgttctttcagaaaatattccactcaacacca  1980

V.1:  1981  aaattgctctcataactgtgacggataaggatgcggaccataatggcagggtgacatgct  2040
            ||||||||||||||||||||||||||||||||||||||||||||||||||||||||||||
V.4:  1981  aaattgctctcataactgtgacggataaggatgcggaccataatggcagggtgacatgct  2040

V.1:  2041  tcacagatcatgaaatccctttcagattaaggccagtattcagtaatcagttcctcctgg  2100
            ||||||||||||||||||||||||||||||||||||||||||||||||||||||||||||
V.4:  2041  tcacagatcatgaaatccctttcagattaaggccagtattcagtaatcagttcctcctgg  2100

V.1:  2101  agactgcagcatatcttgactatgagtccacaaaagaatatgccattaaattactggctg  2160
            ||||||||||||||||||||||||||||||||||||||||||||||||||||||||||||
V.4:  2101  agactgcagcatatcttgactatgagtccacaaaagaatatgccattaaattactggctg  2160

V.1:  2161  cagatgctggcaaacctcctttgaatcagtcagcaatgctcttcatcaaagtgaaagatg  2220
            ||||||||||||||||||||||||||||||||||||||||||||||||||||||||||||
V.4:  2161  cagatgctggcaaacctcctttgaatcagtcagcaatgctcttcatcaaagtgaaagatg  2220

V.1:  2221  aaaatgacaatgctccagttttcacccagtctttcgtaactgtttctattcctgagaata  2280
            ||||||||||||||||||||||||||||||||||||||||||||||||||||||||||||
V.4:  2221  aaaatgacaatgctccagttttcacccagtctttcgtaactgtttctattcctgagaata  2280

V.1:  2281  actctcctggcatccagttgacgaaagtaagtgcaatggatgcagacagtgggcctaatg  2340
            ||||||||||||||||||||||||||||||||||||||||||||||||||||||||||||
V.4:  2281  actctcctggcatccagttgacgaaagtaagtgcaatggatgcagacagtgggcctaatg  2340

V.1:  2341  ctaagatcaattacctgctaggccctgatgctccacctgaattcagcctggattgtcgta  2400
            ||||||||||||||||||||||||||||||||||||||||||||||||||||||||||||
V.4:  2341  ctaagatcaattacctgctaggccctgatgctccacctgaattcagcctggattgtcgta  2400
```

TABLE LIII(c)-continued

Nucleotide sequence alignment of 109P1D4 v.1 (SEQ ID NO: 250) and 109P1D4 v.4 (SEQ ID NO: 251) Score = 7456 bits (3878), Expect = 0.0 Identities = 3878/3878 (100%) Strand = Plus/Plus

```
V.1:  2401  caggcatgctgactgtagtgaagaaactagatagagaaaaagaggataaatatttattca  2460
            ||||||||||||||||||||||||||||||||||||||||||||||||||||||||||||
V.4:  2401  caggcatgctgactgtagtgaagaaactagatagagaaaaagaggataaatatttattca  2460

V.1:  2461  caattctggcaaaagataacggggtaccacccttaaccagcaatgtcacagtctttgtaa  2520
            ||||||||||||||||||||||||||||||||||||||||||||||||||||||||||||
V.4:  2461  caattctggcaaaagataacggggtaccacccttaaccagcaatgtcacagtctttgtaa  2520

V.1:  2521  gcattattgatcagaatgacaatagcccagttttcactcacaatgaatacaacttctatg  2580
            ||||||||||||||||||||||||||||||||||||||||||||||||||||||||||||
V.4:  2521  gcattattgatcagaatgacaatagcccagttttcactcacaatgaatacaacttctatg  2580

V.1:  2581  tcccagaaaaccttccaaggcatggtacagtaggactaatcactgtaactgatcctgatt  2640
            ||||||||||||||||||||||||||||||||||||||||||||||||||||||||||||
V.4:  2581  tcccagaaaaccttccaaggcatggtacagtaggactaatcactgtaactgatcctgatt  2640

V.1:  2641  atggagacaattctgcagttacgctctccattttagatgagaatgatgacttcaccattg  2700
            ||||||||||||||||||||||||||||||||||||||||||||||||||||||||||||
V.4:  2641  atggagacaattctgcagttacgctctccattttagatgagaatgatgacttcaccattg  2700

V.1:  2701  attcacaaactggtgtcatccgaccaaatatttcatttgatagagaaaaacaagaatctt  2760
            ||||||||||||||||||||||||||||||||||||||||||||||||||||||||||||
V.4:  2701  attcacaaactggtgtcatccgaccaaatatttcatttgatagagaaaaacaagaatctt  2760

V.1:  2761  acactttctatgtaaaggctgaggatggtggtagagtatcacgttcttcaagtgccaaag  2820
            ||||||||||||||||||||||||||||||||||||||||||||||||||||||||||||
V.4:  2761  acactttctatgtaaaggctgaggatggtggtagagtatcacgttcttcaagtgccaaag  2820

V.1:  2821  taaccataaatgtggttgatgtcaatgacaacaaaccagttttcattgtccctccttcca  2880
            ||||||||||||||||||||||||||||||||||||||||||||||||||||||||||||
V.4:  2821  taaccataaatgtggttgatgtcaatgacaacaaaccagttttcattgtccctccttcca  2880

V.1:  2881  actgttcttatgaattggttctaccgtccactaatccaggcacagtggtctttcaggtaa  2940
            ||||||||||||||||||||||||||||||||||||||||||||||||||||||||||||
V.4:  2881  actgttcttatgaattggttctaccgtccactaatccaggcacagtggtctttcaggtaa  2940

V.1:  2941  ttgctgttgacaatgacactggcatgaatgcagaggttcgttacagcattgtaggaggaa  3000
            ||||||||||||||||||||||||||||||||||||||||||||||||||||||||||||
V.4:  2941  ttgctgttgacaatgacactggcatgaatgcagaggttcgttacagcattgtaggaggaa  3000

V.1:  3001  acacaagagatctgtttgcaatcgaccaagaaacaggcaacataacattgatggagaaat  3060
            ||||||||||||||||||||||||||||||||||||||||||||||||||||||||||||
V.4:  3001  acacaagagatctgtttgcaatcgaccaagaaacaggcaacataacattgatggagaaat  3060

V.1:  3061  gtgatgttacagaccttggtttacacagagtgttggtcaaagctaatgacttaggacagc  3120
            ||||||||||||||||||||||||||||||||||||||||||||||||||||||||||||
V.4:  3061  gtgatgttacagaccttggtttacacagagtgttggtcaaagctaatgacttaggacagc  3120

V.1:  3121  ctgattctctcttcagtgttgtaattgtcaatctgttcgtgaatgagtcggtgaccaatg  3180
            ||||||||||||||||||||||||||||||||||||||||||||||||||||||||||||
V.4:  3121  gtgatgttacagaccttggtttacacagagtgttggtcaaagctaatgacttaggacagc  3180

V.1:  3181  ctacactgattaatgaactggtgcgcaaaagcactgaagcaccagtgaccccaaatactg  3240
            ||||||||||||||||||||||||||||||||||||||||||||||||||||||||||||
V.4:  3181  ctacactgattaatgaactggtgcgcaaaagcactgaagcaccagtgaccccaaatactg  3240

V.1:  3241  agatagctgatgtatcctcaccaactagtgactatgtcaagatcctggttgcagctgttg  3300
            ||||||||||||||||||||||||||||||||||||||||||||||||||||||||||||
V.4:  3241  agatagctgatgtatcctcaccaactagtgactatgtcaagatcctggttgcagctgttg  3300

V.1:  3301  ctggcaccataactgtcgttgtagttattttcatcactgctgtagtaagatgtcgccagg  3360
            ||||||||||||||||||||||||||||||||||||||||||||||||||||||||||||
V.4:  3301  ctggcaccataactgtcgttgtagttattttcatcactgctgtagtaagatgtcgccagg  3360

V.1:  3361  caccacaccttaaggctgctcagaaaaacaagcagaattctgaatgggctaccccaaacc  3420
            ||||||||||||||||||||||||||||||||||||||||||||||||||||||||||||
V.4:  3361  caccacaccttaaggctgctcagaaaaacaagcagaattctgaatgggctaccccaaacc  3420

V.1:  3421  cagaaaaacaggcagatgataatgatgaagaaaaagaaaaagaagaagaagcatccccta  3480
            ||||||||||||||||||||||||||||||||||||||||||||||||||||||||||||
V.4:  3421  cagaaaaacaggcagatgataatgatgaagaaaaagaaaaagaagaagaagcatccccta  3480
```

TABLE LIII(c)-continued

Nucleotide sequence alignment of 109P1D4 v.1 (SEQ ID NO: 250) and 109P1D4 v.4 (SEQ ID NO: 251) Score = 7456 bits (3878), Expect = 0.0 Identities = 3878/3878 (100%) Strand = Plus/Plus

```
V.1:  3481  agaacttgctgcttaattttgtcactattgaagaaactaaggcagatgatgttgacagtg  3540
            ||||||||||||||||||||||||||||||||||||||||||||||||||||||||||||
V.4:  3481  agaacttgctgcttaattttgtcactattgaagaaactaaggcagatgatgttgacagtg  3540

V.1:  3541  atggaaacagagtcacactagaccttcctattgatctagaagagcaaacaatgggaaagt  3600
            ||||||||||||||||||||||||||||||||||||||||||||||||||||||||||||
V.4:  3541  atggaaacagagtcacactagaccttcctattgatctagaagagcaaacaatgggaaagt  3600

V.1:  3601  acaattgggtaactacacctactactttcaagcccgacagccctgatttggcccgacact  3660
            ||||||||||||||||||||||||||||||||||||||||||||||||||||||||||||
V.4:  3601  acaattgggtaactacacctactactttcaagcccgacagccctgatttggcccgacact  3660

V.1:  3661  acaaatctgcctctccacagcctgccttccaaattcagcctgaaactcccctgaattcga  3720
            ||||||||||||||||||||||||||||||||||||||||||||||||||||||||||||
V.4:  3661  acaaatctgcctctccacagcctgccttccaaattcagcctgaaactcccctgaattcga  3720

V.1:  3721  agcaccacatcatccaagaactgcctctcgataacacctttgtggcctgtgactctatct  3780
            ||||||||||||||||||||||||||||||||||||||||||||||||||||||||||||
V.4:  3721  agcaccacatcatccaagaactgcctctcgataacacctttgtggcctgtgactctatct  3780

V.1:  3781  ccaagtgttcctcaagcagttcagatccctacagcgtttctgactgtggctatccagtga  3840
            ||||||||||||||||||||||||||||||||||||||||||||||||||||||||||||
V.4:  3781  ccaagtgttcctcaagcagttcagatccctacagcgtttctgactgtggctatccagtga  3840

V.1:  3841  cgaccttcgaggtacctgtgtccgtacacaccagaccg  3878
            ||||||||||||||||||||||||||||||||||||||
V.4:  3841  cgaccttcgaggtacctgtgtccgtacacaccagaccg  3878
```

TABLE LIV(c)

Peptide sequences of protein coded by 109P1D4 v.4 (SEQ ID NO: 252)

| | | | | | |
|---|---|---|---|---|---|
| MDLLSGTYIF | AVLLACVVFH | SGAQEKNYTI | REEMPENVLI | GDLLKDLNLS | LIPNKSLTTA 60 |
| MQFKLVYKTG | DVPLIRIEED | TGEIFTTGAR | IDREKLCAGI | PRDEHCFYEV | EVAILPDEIF 120 |
| RLVKIRFLIE | DINDNAPLFP | ATVINISIPE | NSAINSKYTL | PAAVDPDVGI | NGVQNYELIK 180 |
| SQNIFGLDVI | ETPEGDKMPQ | LIVQKELDRE | EKDTYVMKVK | VEDGGFPQRS | STAILQVSVT 240 |
| DTNDNHPVFK | ETEIEVSIPE | NAPVGTSVTQ | LHATDADIGE | NAKIHFSFSN | LVSNIARRLF 300 |
| HLNATTGLIT | IKEPLDREET | PNHKLLVLAS | DGGLMPARAN | VLVNVTDVND | NVPSIDIRYI 360 |
| VNPVNDTVVL | SENIPLNTKI | ALITVTDKDA | DHNGRVTCFT | DHEIPFRLRP | VFSNQFLLET 420 |
| AAYLDYESTK | EYAIKLLAAD | AGKPPLNQSA | MLFIKVKDEN | DNAPVFTQSF | VTVSIPENNS 480 |
| PGIQLTKVSA | MDADSGPNAK | INYLLGPDAP | PEFSLDCRTG | MLTVVKKLDR | EKEDKYLFTI 540 |
| LAKDNGVPPL | TSNVTVFVSI | IDQNDNSPVF | THNEYNFYVP | ENLPRHGTVG | LITVTDPDYG 600 |
| DNSAVTLSIL | DENDDFTIDS | QTGVIRPNIS | FDREKQESYT | FYVKAEDGGR | VSRSSSAKVT 660 |
| INVVDVNDNK | PVFIVPPSNC | SYELVLPSTN | PGTVVFQVIA | VDNDTGMNAE | VRYSIVGGNT 720 |
| RDLFAIDQET | GNITLMEKCD | VTDLGLHRVL | VKANDLGQPD | SLFSVVIVNL | FVNESVTNAT 780 |
| LINELVRKST | EAPVTPNTEI | ADVSSPTSDY | VKILVAAVAG | TITVVVVIFI | TAVVRCRQAP 840 |
| HLKAAQKNKQ | NSEWATPNPE | NRQMIMMKKK | KKKKKHSPKN | LLLNFVTIEE | TKADDVDSDG 900 |
| NRVTLDLPID | LEEQTMGKYN | WVTTPTTFKP | DSPDLARHYK | SASPQPAFQI | QPETPLNSKH 960 |
| HIIQELPLDN | TFVACDSISK | CSSSSSDPYS | VSDCGYPVTT | FEVPVSVHTR | PPMKEVVRSC 1020 |
| TPMKESTTME | IWIHPQPQSQ | RRVTFHLPEG | SQESSSDGGL | GDHDAGSLTS | TSHGLPLGYP 1080 |
| QEEYFDRATP | SNRTEGDGNS | DPESTFIPGL | KKAAEITVQP | TVEEASDNCT | QECLIYGHSD 1140 |
| ACWMPASLDH | SSSSQAQASA | LCHSPPLSQA | STQHHSPRVT | QTIALCNSPP | VTQTIALCHS 1200 |
| PPPIQVSALH | HSPPLVQATA | LHHSPPSAQA | SALCYSPPLA | QAAAISHSSP | LPQVIALHRS 1260 |

TABLE LIV(c)-continued

Peptide sequences of protein coded by 109P1D4 v.4 (SEQ ID NO: 252)

QAQSSVSLQQ GWVQGADGLC SVDQGVQGSA TSQFYTMSER LHPSDDSIKV IPLTTFTPRQ 1320

QARPSRGDSP IMEEHPL 1337

TABLE LV(c)

Amino acid sequence alignment of 109P1D4 v.1 (SEQ ID NO: 253) and 109P1D4 v.4 (SEQ ID NO: 254) Score = 2005 bits (5195), Expect = 0.0 Identities 1011/1011 (100%), Positives = 1011/1011 (100%)

```
V.1   1 MDLLSGTYIFAVLLACVVFHSGAQEKNYTIREEMPENVLIGDLLKDLNLSLIPNKSLTTA 60
        MDLLSGTYIFAVLLACVVFHSGAQEKNYTIREEMPENVLIGDLLKDLNLSLIPNKSLTTA
V.4   1 MDLLSGTYIFAVLLACVVFHSGAQEKNYTIREEMPENVLIGDLLKDLNLSLIPNKSLTTA 60

V.1  61 MQFKLVYKTGDVPLIRIEEDTGEIFTTGARIDREKLCAGIPRDEHCFYEVEVAILPDEIF 120
        MQFKLVYKTGDVPLIRIEEDTGEIFTTGARIDREKLCAGIPRDEHCFYEVEVAILPDEIF
V.4  61 MQFKLVYKTGDVPLIRIEEDTGEIFTTGARIDREKLCAGIPRDEHCFYEVEVAILPDEIF 120

V.1 121 RLVKIRFLIEDINDNAPLFPATVINISIPENSAINSKYTLPAAVDPDVGINGVQNYELIK 180
        RLVKIRFLIEDINDNAPLFPATVINISIPENSAINSKYTLPAAVDPDVGINGVQNYELIK
V.4 121 RLVKIRFLIEDINDNAPLFPATVINISIPENSAINSKYTLPAAVDPDVGINGVQNYELIK 180

V.1 181 SQNIFGLDVIETPEGDKMPQLIVQKELDREEKDTYVMKVKVEDGGFPQRSSTAILQVSVT 240
        SQNIFGLDVIETPEGDKMPQLIVQKELDREEKDTYVMKVKVEDGGFPQRSSTAILQVSVT
V.4 181 SQNIFGLDVIETPEGDKMPQLIVQKELDREEKDTYVMKVKVEDGGFPQRSSTAILQVSVT 240

V.1 241 DTNDNHPVFKETEIEVSIPENAPVGTSVTQLHATDADIGENAKIHFSFSNLVSNIARRLF 300
        DTNDNHPVFKETEIEVSIPENAPVGTSVTQLHATDADIGENAKIHFSFSNLVSNIARRLF
V.4 241 DTNDNHPVFKETEIEVSIPENAPVGTSVTQLHATDADIGENAKIHFSFSNLVSNIARRLF 300

V.1 301 HLNATTGLITIKEPLDREETPNHKLLVLASDGGLMPARAMVLVNVTDVNDNVPSIDIRYI 360
        HLNATTGLITIKEPLDREETPNHKLLVLASDGGLMPARAMVLVNVTDVNDNVPSIDIRYI
V.4 301 HLNATTGLITIKEPLDREETPNHKLLVLASDGGLMPARAMVLVNVTDVNDNVPSIDIRYI 360

V.1 361 VNPVNDTVVLSENIPLNTKIALITVTDKDADHNGRVTCFTDHEIPFRLRPVFSNQFLLET 420
        VNPVNDTVVLSENIPLNTKIALITVTDKDADHNGRVTCFTDHEIPFRLRPVFSNQFLLET
V.4 361 VNPVNDTVVLSENIPLNTKIALITVTDKDADHNGRVTCFTDHEIPFRLRPVFSNQFLLET 420

V.1 421 AAYLDYESTKEYAIKLLAADAGKPPLNQSAMLFIKVKDENDNAPVFTQSFVTVSIPENNS 480
        AAYLDYESTKEYAIKLLAADAGKPPLNQSAMLFIKVKDENDNAPVFTQSFVTVSIPENNS
V.4 421 AAYLDYESTKEYAIKLLAADAGKPPLNQSAMLFIKVKDENDNAPVFTQSFVTVSIPENNS 480

V.1 481 PGIQLTKVSANDADSGPNAKINYLLGPDAPPEFSLDCRTGMLTVVKKLDREKEDKYLFTI 540
        PGIQLTKVSANDADSGPNAKINYLLGPDAPPEFSLDCRTGMLTVVKKLDREKEDKYLFTI
V.4 481 PGIQLTKVSANDADSGPNAKINYLLGPDAPPEFSLDCRTGMLTVVKKLDREKEDKYLFTI 540

V.1 541 LAKDNGVPPLTSNVTVFVSIIDQNDNSPVFTHNEYNFYVPENLPRHGTVGLITVTDPDYG 600
        LAKDNGVPPLTSNVTVFVSIIDQNDNSPVFTHNEYNFYVPENLPRHGTVGLITVTDPDYG
V.4 541 LAKDNGVPPLTSNVTVFVSIIDQNDNSPVFTHNEYNFYVPENLPRHGTVGLITVTDPDYG 600

V.1 601 DNSAVTLSILDENDDFTIDSQTGVIRPNISFDREKQESYTFYVKAEDGGRVSRSSSAKVT 660
        DNSAVTLSILDENDDFTIDSQTGVIRPNISFDREKQESYTFYVKAEDGGRVSRSSSAKVT
V.4 601 DNSAVTLSILDENDDFTIDSQTGVIRPNISFDREKQESYTFYVKAEDGGRVSRSSSAKVT 660

V.1 661 INVVDVNDNKPVFIVPPSNCSYELVLPSTNPGTVVFQVIAVDNDTGMNAEVRYSIVGGNT 720
        INVVDVNDNKPVFIVPPSNCSYELVLPSTNPGTVVFQVIAVDNDTGMNAEVRYSIVGGNT
V.4 661 INVVDVNDNKPVFIVPPSNCSYELVLPSTNPGTVVFQVIAVDNDTGMNAEVRYSIVGGNT 720

V.1 721 RDLFAIDQETGNITLMEKCDVTDLGLHRVLVKANDLGQPDSLFSVVIVNLFVNESVTNAT 780
        RDLFAIDQETGNITLMEKCDVTDLGLHRVLVKANDLGQPDSLFSVVIVNLFVNESVTNAT
V.4 721 RDLFAIDQETGNITLMEKCDVTDLGLHRVLVKANDLGQPDSLFSVVIVNLFVNESVTNAT 780

V.1 781 LINELVRKSTEAPVTPNTEIADVSSPTSDYVKILVAAVAGTITVVVVIFITAVVRCRQAP 840
        LI ELVRKSTEAPVTPNTEIADVSSPTSDYVKILVAAVAGTITVVVVIFITAVVRCRQAP
V.4 781 LIMELVRKSTEAPVTPNTEIADVSSPTSDYVKILVAAVAGTITVVVVIFITAVVRCRQAP 840

V.1 841 HLKAAQKNKQNSEWATPNPENRQMIMMKKKKKKKKHSPKNLLLNFVTIEETKADDVDSGD 900
        HLKAAQKNKQNSEWATPNPENRQMIMMKKKKKKKKHSPKNLLLNFVTIEETKADDVDSDG
V.4 841 HLKAAQKNKQNSEWATPNPENRQMIMMKKKKKKKKHSPKNLLLNFVTIEETKADDVDSDG 900

V.1 901 NRVTLDLPIDLEEQTMGKYNWVTTPTTFKPDSPDLARHYKSASPQPAFQIQPETPLNSKH 960
        NRVTLDLPIDLEEQTMGKYNWVTTPTTFKPDSPDLARHYKSASPQPAFQIQPETPLNSKH
V.4 901 NRVTLDLPIDLEEQTMGKYNWVTTPTTFKPDSPDLARHYKSASPQPAFQIQPETPLNSKH 960
```

TABLE LV(c)-continued

Amino acid sequence alignment of 109P1D4 v.1 (SEQ ID NO: 253) and 109P1D4 v.4 (SEQ ID NO: 254) Score = 2005 bits (5195), Expect = 0.0Identities 1011/1011 (100%), Positives = 1011/1011 (100%)

```
V.1 961 HIIQELPLDNTFVACDSISKCSSSSSDPYSVSDCGYPVTTFEVPVSVHTRP 1011
        HIIQELPLDNTFVACDSISKCSSSSSDPYSVSDCGYPVTTFEVPVSVHTRP
V.4 961 HIIQELPLDNTFVACDSISKCSSSSSDPYSVSDCGYPVTTFEVPVSVHTRP 1011
```

TABLE LII(d)

Nucleotide sequence of transcript variant 109P1D4v.5 (SEQ ID NO: 255)

```
ctggtggtcc agtacctcca aagatatgga atacactcct gaaatatcct gaaaacttt     60
tttttttcaga atcctttaat aagcagttat gtcaatctga agttgctta cttgtacttt   120
atattaatag ctattcttgt ttttcttatc caaagaaaaa tcctctaatc cccttttcac   180
atgatagttg ttaccatgtt taggcattag tcacatcaac ccctctcctc tcccaaactt   240
ctcttcttca aatcaaactt tattagtccc tccttataa tgattccttg cctcgtttta   300
tccagatcaa ttttttttca ctttgatgcc cagagctgaa gaaatggact actgtataaa   360
ttattcattg ccaagagaat aattgcattt taaacccata ttataacaaa gaataatgat   420
tatattttgt gatttgtaac aaatacccctt tattttccct taactattga attaaatatt   480
ttaattattt gtattctctt taactatctt ggtatattaa agtattatct tttatatatt   540
tatcaatggt ggacactttt ataggtactc tgtgtcattt ttgatactgt aggtatctta   600
tttcatttat ctttattctt aatgtacgaa ttcataatat ttgattcaga acaaatttat   660
cactaattaa cagagtgtca attatgctaa catctcattt actgatttta atttaaaaca   720
gttttttgtta acatgcatgt ttaggggttgg cttcttaata atttcttctt cctcttctct   780
ctctcctctt cttttggtca gtgttgtgcg ggttaataca acaaactgta acaagtgtac   840
ctggtatgga cttgttgtcc gggacgtaca ttttcgcggt cctgctagca tgcgtggtgt   900
tccactctgg cgcccaggag aaaaactaca ccatccgaga agaaatgcca gaaaacgtcc   960
tgataggcga cttgttgaaa gaccttaact tgtcgctgat tccaaacaag tccttgacaa  1020
ctgctatgca gttcaagcta gtgtacaaga ccggagatgt gccactgatt cgaattgaag  1080
aggatactgg tgagatcttc actactggcg ctcgcattga tcgtgagaaa ttatgtgctg  1140
gtatcccaag ggatgagcat tgcttttatg aagtggaggt tgccattttg ccggatgaaa  1200
tatttagact ggttaagata cgttttctga tagaagatat aaatgataat gcaccattgt  1260
tcccagcaac agttatcaac atatcaattc cagagaactc ggctataaac tctaaatata  1320
ctctcccagc ggctgttgat cctgacgtag gaataaacgg agttcaaaac tacgaactaa  1380
ttaagagtca aaacattttt ggcctcgatg tcattgaaac accagaagga gacaagatgc  1440
cacaactgat tgttcaaaag gagttagata gggaagagaa ggatacctac gtgatgaaag  1500
taaaggttga agatggtggc tttcctcaaa gatccagtac tgctattttg caagtgagtg  1560
ttactgatac aaatgacaac cacccagtct ttaaggagac agagattgaa gtcagtatac  1620
cagaaaatgc tcctgtaggc acttcagtga cacagctcca tgccacagat gctgacatag  1680
gtgaaaatgc caagatccac ttctcttttca gcaatctagt ctccaacatt gccaggagat  1740
tatttcaccct caatgccacc actggactta tcacaatcaa agaaccactg gataggggaag  1800
aaacaccaaa ccacaagtta ctggttttgg caagtgatgg tggattgatg ccagcaagag  1860
caatggtgct ggtaaatgtt acagatgtca atgataatgt cccatccatt gacataagat  1920
acatcgtcaa tcctgtcaat gacacagttg ttctttcaga aaatattcca ctcaacacca  1980
```

TABLE LII(d)-continued

Nucleotide sequence of transcript variant 109P1D4v.5 (SEQ ID NO: 255)

```
aaattgctct cataactgtg acggataagg atgcggacca taatggcagg gtgacatgct    2040
tcacagatca tgaaatccct ttcagattaa ggccagtatt cagtaatcag ttcctcctgg    2100
agactgcagc atatcttgac tatgagtcca caaaagaata tgccattaaa ttactggctg    2160
cagatgctgg caaacctcct ttgaatcagt cagcaatgct cttcatcaaa gtgaaagatg    2220
aaaatgacaa tgctccagtt ttcacccagt ctttcgtaac tgtttctatt cctgagaata    2280
actctcctgg catccagttg acgaaagtaa gtgcaatgga tgcagacagt gggcctaatg    2340
ctaagatcaa ttacctgcta ggccctgatg ctccacctga attcagcctg gattgtcgta    2400
caggcatgct gactgtagtg aagaaactag atagagaaaa agaggataaa tatttattca    2460
caattctggc aaaagataac ggggtaccac ccttaaccag caatgtcaca gtctttgtaa    2520
gcattattga tcagaatgac aatagcccag ttttcactca caatgaatac aacttctatg    2580
tcccagaaaa ccttccaagg catggtacag taggactaat cactgtaact gatcctgatt    2640
atggagacaa ttctgcagtt acgctctcca ttttagatga gaatgatgac ttcaccattg    2700
attcacaaac tggtgtcatc cgaccaaata tttcatttga tagagaaaaa caagaatctt    2760
acactttcta tgtaaaggct gaggatggtg gtagagtatc acgttcttca agtgccaaag    2820
taaccataaa tgtggttgat gtcaatgaca acaaaccagt tttcattgtc cctccttcca    2880
actgttctta tgaattggtt ctaccgtcca ctaatccagg cacagtggtc tttcaggtaa    2940
ttgctgttga caatgacact ggcatgaatg cagaggttcg ttacagcatt gtaggaggaa    3000
acacaagaga tctgtttgca atcgaccaag aaacaggcaa cataacattg atggagaaat    3060
gtgatgttac agaccttggt ttacacagag tgttggtcaa agctaatgac ttaggacagc    3120
ctgattctct cttcagtgtt gtaattgtca atctgttcgt gaatgagtcg gtgaccaatg    3180
ctacactgat taatgaactg gtgcgcaaaa gcactgaagc accagtgacc ccaaatactg    3240
agatagctga tgtatcctca ccaactagtg actatgtcaa gatcctggtt gcagctgttg    3300
ctggcaccat aactgtcgtt gtagttattt tcatcactgc tgtagtaaga tgtcgccagg    3360
caccacacct taaggctgct cagaaaaaca agcagaattc tgaatgggct accccaaacc    3420
cagaaaacag gcagatgata atgatgaaga aaagaaaaa gaagaagaag cattcccta     3480
agaacttgct gcttaatttt gtcactattg aagaaactaa ggcagatgat gttgacagtg    3540
atggaaacag agtcacacta gaccttccta ttgatctaga agagcaaaca atgggaaagt    3600
acaattgggt aactacacct actactttca agcccgacag ccctgatttg gcccgacact    3660
acaaatctgc ctctccacag cctgccttcc aaattcagcc tgaaactccc ctgaattcga    3720
agcaccacat catccaagaa ctgcctctcg ataacacctt tgtggcctgt gactctatct    3780
ccaagtgttc ctcaagcagt tcagatccct acagcgtttc tgactgtggc tatccagtga    3840
cgaccttcga ggtacctgtg tccgtacaca ccagaccgtc ccagcggcgt gtcacatttc    3900
acctgccaga aggctctcag gaaagcagca gtgatggtgg actgggagac catgatgcag    3960
gcagccttac cagcacatct catggcctgc cccttggcta tcctcaggag gagtactttg    4020
atcgtgctac acccagcaat cgcactgaag gggatggcaa ctccgatcct gaatctactt    4080
tcatacctgg actaaagaaa gctgcagaaa taactgttca accaactgtg gaagaggcct    4140
ctgacaactg cactcaagaa tgtctcatct atggccattc tgatgcctgc tggatgccgg    4200
catctctgga tcattccagc tcttcgcaag cacaggcctc tgctctatgc cacagcccac    4260
cactgtcaca ggcctctact cagcaccaca gcccacgagt gacacagacc attgctctct    4320
```

TABLE LII(d)-continued

Nucleotide sequence of transcript variant 109P1D4v.5 (SEQ ID NO: 255)

| | |
|---|---|
| gccacagccc tccagtgaca cagaccatcg cattgtgcca cagcccacca ccgatacagg | 4380 |
| tgtctgctct ccaccacagt cctcctctag tgcaggctac tgcacttcac cacagcccac | 4440 |
| catcagcaca ggcctcagcc ctctgctaca gccctccttt agcacaggct gctgcaatca | 4500 |
| gccacagctc tcctctgcca caggttattg ccctccatcg tagtcaggcc caatcatcag | 4560 |
| tcagtttgca gcaaggttgg gtgcaaggtg ctgatgggct atgctctgtt gatcagggag | 4620 |
| tgcaaggtag tgcaacatct cagtttaca ccatgtctga aagacttcat cccagtgatg | 4680 |
| attcaattaa agtcattcct ttgacaacct tcactccacg ccaacaggcc agaccgtcca | 4740 |
| gaggtgattc ccccattatg gaagaacatc ccttgtaaag ctaaaatagt tacttcaaat | 4800 |
| tttcagaaaa gatgtatata gtcaaaattt aagatacaat tccaatgagt attctgatta | 4860 |
| tcagatttgt aaataactat gtaaatagaa acagatacca gaataaatct acagctagac | 4920 |
| ccttagtcaa tagttaacca aaaaattgca atttgtttaa ttcagaatgt gtatttaaaa | 4980 |
| agaaaaggaa tttaacaatt tgcatcccct tgtacagtaa ggcttatcat gacagagcgc | 5040 |
| actatttctg atgtacagta ttttttgttg tttttatcat catgtgcaat attactgatt | 5100 |
| tgtttccatg ctgattgtgt ggaaccagta tgtagcaaat ggaaagccta gaaatatctt | 5160 |
| attttctaag tttaccttta gtttacctaa acttttgttc agataacgtt aaaaggtata | 5220 |
| cgtactctag cctttttttg ggcttctt ttgatttttg tttgttgttt tcagttttt | 5280 |
| tgttgttgtt agtgagtctc ccttcaaaat acgcagtagg tagtgtaaat actgcttgtt | 5340 |
| tgtgtctctc tgctgtcatg tttctacct tattccaata ctatattgtt gataaaattt | 5400 |
| gtatatacat tttcaataaa gaatatgtat aaactgtaca gatctagatc tacaacctat | 5460 |
| ttctctactc tttagtagag ttcgagacac agaagtgcaa taactgccct aattaagcaa | 5520 |
| ctatttgtta aaaagggcct ctttttactt taatagttta gtgtaaagta catcagaaat | 5580 |
| aaagctgtat ctgccatttt aagcctgtag tccattatta cttgggtctt tacttctggg | 5640 |
| aatttgtatg taacagccta gaaaattaaa aggaggtgga tgcatccaaa gcacgagtca | 5700 |
| cttaaaatat cgacggtaaa ctactatttt gtagagaaac tcaggaagat ttaaatgttg | 5760 |
| atttgacagc tcaataggct gttaccaaag ggtgttcagt aaaaataaca aatacatgta | 5820 |
| actgtagata aaaccatata ctaaatctat aagactaagg gattttgtt attctagctc | 5880 |
| aacttactga agaaaaccac taataacaac aagaatatca ggaaggaact tttcaagaaa | 5940 |
| tgtaattata aatctacatc aaacagaatt ttaaggaaaa atgcagaggg agaaataagg | 6000 |
| cacatgactg cttcttgcag tcaacaagaa ataccaataa cacacacaga acaaaaacca | 6060 |
| tcaaaatctc atatatgaaa taaaatatat tcttctaagc aaagaaacag tactattcat | 6120 |
| agaaaacatt agtttcttc tgttgtctgt tatttccttc ttgtatcctc ttaactggcc | 6180 |
| attatcttgt atgtgcacat tttataaatg tacagaaaca tcaccaactt aattttcttc | 6240 |
| catagcaaaa ctgagaaaat accttgtttc agtataacac taaaccaaga gacaattgat | 6300 |
| gtttaatggg ggcggttggg gtgggggggg gagtcaatat ctcctattga ttaacttaga | 6360 |
| catagatttt gtaatgtata acttgatatt taatttatga ttaaactgtg tgtaaatttt | 6420 |
| gtaacataaa ctgtggtaat tgcataattt cattggtgag gatttccact gaatattgag | 6480 |
| aaagtttctt ttcatgtgcc cagcaggtta agtagcgttt tcagaatata cattattccc | 6540 |
| atccattgta aagttcctta agtcatattt gactgggcgt gcagaataac ttcttaactt | 6600 |
| ttaactatca gagtttgatt aataaaatta attaatgttt tttctccttc gtgttgttaa | 6660 |

TABLE LII(d)-continued

Nucleotide sequence of transcript variant 109P1D4v.5 (SEQ ID NO: 255)

```
tgttccaagg gatttggagc atactggttt tccaggtgca tgtgaatccc gaaggactga   6720
tgatatttga atgtttatta aattattatc atacaaatgt gttgatattg tggctattgt   6780
tgatgttgaa aattttaaac ttggggaaga ttaagaaaag aaccaatagt gacaaaaatc   6840
agtgcttcca gtagatttta gaacattctt tgcctcaaaa aacctgcaaa gatgatgtga   6900
gatttttttct tgtgttttaa ttattttcac attttctctc tgcaaaactt tagttttctg   6960
atgatctaca cacacacaca cacacacacg tgcacacaca cacacattta aatgatataa   7020
aaagaagagg ttgaaagatt attaaataac ttatcaggca tctcaatggt tactatctat   7080
gttagtgaaa atcaaatagg actcaaagtt ggatatttgg gattttctt ctgacagtat    7140
aatttattga gttactaggg aggttcttaa atcctcatat ctggaaactt gtgacgtttt   7200
gacacctttc ctatagatga tataggaatg aaccaatacg cttttattac cctttctaac   7260
tctgatttta taatcagact tagattgtgt ttagaatatt aaatgactgg gcaccctctt   7320
cttggttttt accagagagg ctttgaatgg aagcaggctg agagtagcca aagaggcaag   7380
gggtattagc ccagttattc tcccctatgc cttccttctc tttctaagcg tccactaggt   7440
ctggccttgg aaacctgtta cttctagggc ttcagatctg atgatatctt tttcatcaca   7500
ttacaagtta tttctctgac tgaatagaca gtggtatagg ttgacacagc acacaagtgg   7560
ctattgtgat gtatgatgta tgtagtccta caactgcaaa acgtcttact gaaccaacaa   7620
tcaaaaaatg gttctgtttt aaaaaggatt ttgtttgatt tgaaattaaa acttcaagct   7680
gaatgactta tatgagaata atacgttcaa tcaaagtagt tattctattt tgtgtccata   7740
ttccattaga ttgtgattat taattttcta gctatggtat tactatatca cacttgtgag   7800
tatgtattca aatactaagt atcttatatg ctacgtgcat acacattctt ttcttaaact   7860
ttacctgtgt tttaactaat attgtgtcag tgtattaaaa attagctttt acatatgata   7920
tctacaatgt aataaattta gagagtaatt ttgtgtattc ttatttactt aacattttac   7980
ttttaattat gtaaatttgg ttagaaaata ataataaatg gttagtgcta ttgtgtaatg   8040
gtagcagtta caaagagcct ctgccttccc aaactaatat ttatcacaca tggtcattaa   8100
atgggaaaaa aatagactaa acaaatcaca aattgttcag ttcttaaaat gtaattatgt   8160
cacacacaca aaaaatcctt ttcaatcctg agaaaattaa aggcgtttta ctcacatggc   8220
tatttcaaca ttagttttttt ttgtttgttt cttttttcatg gtattactga aggtgtgtat   8280
actccctaat acacatttat gaaaatctac ttgtttaggc ttttatttat actcttctga   8340
tttatatttt ttattataat tattatttct tatctttctt ctttttatatt ttttggaaac   8400
caaatttata gttagtttag gtaaactttt tattatgacc attagaaact attttgaatg   8460
cttccaactg gctcaattgg ccgggaaaac atgggagcaa gagaagctga atatatttc    8520
tgcaagaacc tttctatatt atgtgccaat taccacacca gatcaatttt atgcagaggc   8580
cttaaaatat tctttcacag tagctttctt acactaaccg tcatgtgctt ttagtaaata   8640
tgattttttaa aagcagttca gttgacaac agcagaaaca gtaacaaaaa aatctgctca    8700
gaaaaatgta tgtgcacaaa taaaaaaaat taatggcaat tgtttagtga ttgtaagtga   8760
tacttttttaa agagtaaact gtgtgaaatt tatactatcc ctgcttaaaa tattaagatt   8820
tttatgaaat atgtatttat gtttgtattg tgggaagatt cctcctctgt gatatcatac   8880
agcatctgaa agtgaacagt atcccaaagc agttccaacc atgctttgga agtaagaagg   8940
ttgactattg tatggccaag gatggcagta tgtaatccag aagcaaactt gtattaattg   9000
```

TABLE LII(d)-continued

Nucleotide sequence of transcript variant 109P1D4v.5 (SEQ ID NO: 255)

```
ttctatttca ggttctgtat tgcatgtttt cttattaata tatattaata aaagttatga    9060
gaaat                                                                9065
```

TABLE LIII(d)

Nucleotide sequence alignment of 109P1D4 v.1 (SEQ ID NO: 256) and 109P1D4 v.5 (SEQ ID NO: 257) Score = 7456 bits (3878), Expect = 0.0 Identities = 3878/3878 (100%) Strand = Plus/Plus

```
V.1:     1  ctggtggtccagtacctccaaagatatggaatacactcctgaaatatcctgaaaacttttt   60
            ||||||||||||||||||||||||||||||||||||||||||||||||||||||||||||
V.5:     1  ctggtggtccagtacctccaaagatatggaatacactcctgaaatatcctgaaaacttttt   60

V.1:    61  tttttcagaatcctttaataagcagttatgtcaatctgaaagttgcttacttgtactttt  120
            ||||||||||||||||||||||||||||||||||||||||||||||||||||||||||||
V.5:    61  tttttcagaatcctttaataagcagttatgtcaatctgaaagttgcttacttgtactttt  120

V.1:   121  atattaatagctattcttgttttttcttatccaaagaaaaatcctctaatccccttttcac  180
            ||||||||||||||||||||||||||||||||||||||||||||||||||||||||||||
V.5:   121  atattaatagctattcttgttttttcttatccaaagaaaaatcctctaatccccttttcac  180

V.1:   181  atgatagttgttaccatgtttaggcattagtcacatcaacccctctcctctcccaaactt  240
            ||||||||||||||||||||||||||||||||||||||||||||||||||||||||||||
V.5:   181  atgatagttgttaccatgtttaggcattagtcacatcaacccctctcctctcccaaactt  240

V.1:   241  ctcttcttcaaatcaaactttattagtccctcctttataatgattccttgcctcgtttta  300
            ||||||||||||||||||||||||||||||||||||||||||||||||||||||||||||
V.5:   241  ctcttcttcaaatcaaactttattagtccctcctttataatgattccttgcctcgtttta  300

V.1:   301  tccagatcaattttttttcactttgatgcccagagctgaagaaatggactactgtataaa  360
            ||||||||||||||||||||||||||||||||||||||||||||||||||||||||||||
V.5:   301  tccagatcaattttttttcactttgatgcccagagctgaagaaatggactactgtataaa  360

V.1:   361  ttattcattgccaagagaataattgcattttaaacccatattataacaaagaataatgat  420
            ||||||||||||||||||||||||||||||||||||||||||||||||||||||||||||
V.5:   361  ttattcattgccaagagaataattgcattttaaacccatattataacaaagaataatgat  420

V.1:   421  tatattttgtgatttgtaacaaatacccttttattttcccttaactattgaattaaatatt  480
            ||||||||||||||||||||||||||||||||||||||||||||||||||||||||||||
V.5:   421  tatattttgtgatttgtaacaaatacccttttattttcccttaactattgaattaaatatt  480

V.1:   481  ttaattatttgtattctctttaactatcttggtatattaaagtattatcttttatatatt  540
            ||||||||||||||||||||||||||||||||||||||||||||||||||||||||||||
V.5:   481  ttaattatttgtattctctttaactatcttggtatattaaagtattatcttttatatatt  540

V.1:   541  tatcaatggtggacacttttataggtactctgtgtcattttgatactgtaggtatctta  600
            ||||||||||||||||||||||||||||||||||||||||||||||||||||||||||||
V.5:   541  tatcaatggtggacacttttataggtactctgtgtcattttgatactgtaggtatctta  600

V.1:   601  tttcatttatctttattcttaatgtacgaattcataatatttgattcagaacaaatttat  660
            ||||||||||||||||||||||||||||||||||||||||||||||||||||||||||||
V.5:   601  tttcatttatctttattcttaatgtacgaattcataatatttgattcagaacaaatttat  660

V.1:   661  cactaattaacagagtgtcaattatgctaacatctcatttactgattttaatttaaaaca  720
            ||||||||||||||||||||||||||||||||||||||||||||||||||||||||||||
V.5:   661  cactaattaacagagtgtcaattatgctaacatctcatttactgattttaatttaaaaca  720

V.1:   721  gttttttgttaacatgcatgtttagggttggcttcttaataatttcttcttcctcttctct  780
            ||||||||||||||||||||||||||||||||||||||||||||||||||||||||||||
V.5:   721  gttttttgttaacatgcatgtttagggttggcttcttaataatttcttcttcctcttctct  780

V.1:   781  ctctcctcttcttttggtcagtgttgtgcgggttaatacaacaaactgtaacaagtgtac  840
            ||||||||||||||||||||||||||||||||||||||||||||||||||||||||||||
V.5:   781  ctctcctcttcttttggtcagtgttgtgcgggttaatacaacaaactgtaacaagtgtac  840

V.1:   841  ctggtatggacttgttgtccgggacgtacattttcgcggtcctgctagcatgcgtggtgt  900
            ||||||||||||||||||||||||||||||||||||||||||||||||||||||||||||
V.5:   841  ctggtatggacttgttgtccgggacgtacattttcgcggtcctgctagcatgcgtggtgt  900
```

TABLE LIII(d)-continued

Nucleotide sequence alignment of 109P1D4 v.1 (SEQ ID NO: 256) and
109P1D4 v.5 (SEQ ID NO: 257) Score = 7456 bits (3878),
Expect = 0.0 Identities = 3878/3878 (100%) Strand = Plus/Plus

```
V.1:  901  tccactctggcgcccaggagaaaaactacaccatccgagaagaaatgccagaaaacgtcc  960
           ||||||||||||||||||||||||||||||||||||||||||||||||||||||||||||
V.5:  901  tccactctggcgcccaggagaaaaactacaccatccgagaagaaatgccagaaaacgtcc  960

V.1:  961  tgataggcgacttgttgaaagaccttaacttgtcgctgattccaaacaagtccttgacaa  1020
           ||||||||||||||||||||||||||||||||||||||||||||||||||||||||||||
V.5:  961  tgataggcgacttgttgaaagaccttaacttgtcgctgattccaaacaagtccttgacaa  1020

V.1: 1021  ctgctatgcagttcaagctagtgtacaagaccggagatgtgccactgattcgaattgaag  1080
           ||||||||||||||||||||||||||||||||||||||||||||||||||||||||||||
V.5: 1021  ctgctatgcagttcaagctagtgtacaagaccggagatgtgccactgattcgaattgaag  1080

V.1: 1081  aggatactggtgagatcttcactactggcgctcgcattgatcgtgagaaattatgtgctg  1140
           ||||||||||||||||||||||||||||||||||||||||||||||||||||||||||||
V.5: 1081  aggatactggtgagatcttcactactggcgctcgcattgatcgtgagaaattatgtgctg  1140

V.1: 1141  gtatcccaagggatgagcattgcttttatgaagtggaggttgccattttgccggatgaaa  1200
           ||||||||||||||||||||||||||||||||||||||||||||||||||||||||||||
V.5: 1141  gtatcccaagggatgagcattgcttttatgaagtggaggttgccattttgccggatgaaa  1200

V.1: 1201  tatttagactggttaagatacgttttctgatagaagatataaatgataatgcaccattgt  1260
           ||||||||||||||||||||||||||||||||||||||||||||||||||||||||||||
V.5: 1201  tatttagactggttaagatacgttttctgatagaagatataaatgataatgcaccattgt  1260

V.1: 1261  tcccagcaacagttatcaacatatcaattccagagaactcggctataaactctaaatata  1320
           ||||||||||||||||||||||||||||||||||||||||||||||||||||||||||||
V.5: 1261  tcccagcaacagttatcaacatatcaattccagagaactcggctataaactctaaatata  1320

V.1: 1321  ctctcccagcggctgttgatcctgacgtaggaataaacggagttcaaaactacgaactaa  1380
           ||||||||||||||||||||||||||||||||||||||||||||||||||||||||||||
V.5: 1321  ctctcccagcggctgttgatcctgacgtaggaataaacggagttcaaaactacgaactaa  1380

V.1: 1381  ttaagagtcaaaacattttttggcctcgatgtcattgaaacaccagaaggagacaagatgc  1440
           ||||||||||||||||||||||||||||||||||||||||||||||||||||||||||||
V.5: 1381  ttaagagtcaaaacattttttggcctcgatgtcattgaaacaccagaaggagacaagatgc  1440

V.1: 1441  cacaactgattgttcaaaaggagttagataggaaagaagaaggatacctacgtgatgaaag  1500
           ||||||||||||||||||||||||||||||||||||||||||||||||||||||||||||
V.5: 1441  cacaactgattgttcaaaaggagttagataggaaagaagaaggatacctacgtgatgaaag  1500

V.1: 1501  taaaggttgaagatggtggctttcctcaaagatccagtactgctattttgcaagtgagtg  1560
           ||||||||||||||||||||||||||||||||||||||||||||||||||||||||||||
V.5: 1501  taaaggttgaagatggtggctttcctcaaagatccagtactgctattttgcaagtgagtg  1560

V.1: 1561  ttactgatacaaatgacaaccacccagtctttaaggagacagagattgaagtcagtatac  1620
           ||||||||||||||||||||||||||||||||||||||||||||||||||||||||||||
V.5: 1561  ttactgatacaaatgacaaccacccagtctttaaggagacagagattgaagtcagtatac  1620

V.1: 1621  cagaaaatgctcctgtaggcacttcagtgacacagctccatgccacagatgctgacatag  1680
           ||||||||||||||||||||||||||||||||||||||||||||||||||||||||||||
V.5: 1621  cagaaaatgctcctgtaggcacttcagtgacacagctccatgccacagatgctgacatag  1680

V.1: 1681  gtgaaaatgccaagatccacttctctttcagcaatctagtctccaacattgccaggagat  1740
           ||||||||||||||||||||||||||||||||||||||||||||||||||||||||||||
V.5: 1681  gtgaaaatgccaagatccacttctctttcagcaatctagtctccaacattgccaggagat  1740

V.1: 1741  tatttcacctcaatgccaccactggacttatcacaatcaaagaaccactggatagggaag  1800
           ||||||||||||||||||||||||||||||||||||||||||||||||||||||||||||
V.5: 1741  tatttcacctcaatgccaccactggacttatcacaatcaaagaaccactggatagggaag  1800

V.1: 1801  aaacaccaaaccacaagttactggttttggcaagtgatggtggattgatgccagcaagag  1860
           ||||||||||||||||||||||||||||||||||||||||||||||||||||||||||||
V.5: 1801  aaacaccaaaccacaagttactggttttggcaagtgatggtggattgatgccagcaagag  1860

V.1: 1861  caatggtgctggtaaatgttacagatgtcaatgataatgtcccatccattgacataagat  1920
           ||||||||||||||||||||||||||||||||||||||||||||||||||||||||||||
V.5: 1861  caatggtgctggtaaatgttacagatgtcaatgataatgtcccatccattgacataagat  1920

V.1: 1921  acatcgtcaatcctgtcaatgacacagttgttctttcagaaaatattccactcaacacca  1980
           ||||||||||||||||||||||||||||||||||||||||||||||||||||||||||||
V.5: 1921  acatcgtcaatcctgtcaatgacacagttgttctttcagaaaatattccactcaacacca  1980
```

TABLE LIII(d)-continued

Nucleotide sequence alignment of 109P1D4 v.1 (SEQ ID NO: 256) and
109P1D4 v.5 (SEQ ID NO: 257) Score = 7456 bits (3878),
Expect = 0.0 Identities = 3878/3878 (100%) Strand = Plus/Plus

```
V.1:  1981  aaattgctctcataactgtgacggataaggatgcggaccataatggcagggtgacatgct  2040
            ||||||||||||||||||||||||||||||||||||||||||||||||||||||||||||
V.5:  1981  aaattgctctcataactgtgacggataaggatgcggaccataatggcagggtgacatgct  2040

V.1:  2041  tcacagatcatgaaatccctttcagattaaggccagtattcagtaatcagttcctcctgg  2100
            ||||||||||||||||||||||||||||||||||||||||||||||||||||||||||||
V.5:  2041  tcacagatcatgaaatccctttcagattaaggccagtattcagtaatcagttcctcctgg  2100

V.1:  2101  agactgcagcatatcttgactatgagtccacaaaagaatatgccattaaattactggctg  2160
            ||||||||||||||||||||||||||||||||||||||||||||||||||||||||||||
V.5:  2101  agactgcagcatatcttgactatgagtccacaaaagaatatgccattaaattactggctg  2160

V.1:  2161  cagatgctggcaaacctcctttgaatcagtcagcaatgctcttcatcaaagtgaaagatg  2220
            ||||||||||||||||||||||||||||||||||||||||||||||||||||||||||||
V.5:  2161  cagatgctggcaaacctcctttgaatcagtcagcaatgctcttcatcaaagtgaaagatg  2220

V.1:  2221  aaaatgacaatgctccagttttcacccagtctttcgtaactgtttctattcctgagaata  2280
            ||||||||||||||||||||||||||||||||||||||||||||||||||||||||||||
V.5:  2221  aaaatgacaatgctccagttttcacccagtctttcgtaactgtttctattcctgagaata  2280

V.1:  2281  actctcctggcatccagttgacgaaagtaagtgcaatggatgcagacagtgggcctaatg  2340
            ||||||||||||||||||||||||||||||||||||||||||||||||||||||||||||
V.5:  2281  actctcctggcatccagttgacgaaagtaagtgcaatggatgcagacagtgggcctaatg  2340

V.1:  2341  ctaagatcaattacctgctaggccctgatgctccacctgaattcagcctggattgtcgta  2400
            ||||||||||||||||||||||||||||||||||||||||||||||||||||||||||||
V.5:  2341  ctaagatcaattacctgctaggccctgatgctccacctgaattcagcctggattgtcgta  2400

V.1:  2401  caggcatgctgactgtagtgaagaaactagatagagaaaagaggataaatatttattca  2460
            ||||||||||||||||||||||||||||||||||||||||||||||||||||||||||||
V.5:  2401  caggcatgctgactgtagtgaagaaactagatagagaaaagaggataaatatttattca  2460

V.1:  2461  caattctggcaaaagataacggggtaccacccttaaccagcaatgtcacagtctttgtaa  2520
            ||||||||||||||||||||||||||||||||||||||||||||||||||||||||||||
V.5:  2461  caattctggcaaaagataacggggtaccacccttaaccagcaatgtcacagtctttgtaa  2520

V.1:  2521  gcattattgatcagaatgacaatagcccagttttcactcacaatgaatacaacttctatg  2580
            ||||||||||||||||||||||||||||||||||||||||||||||||||||||||||||
V.5:  2521  gcattattgatcagaatgacaatagcccagttttcactcacaatgaatacaacttctatg  2580

V.1:  2581  tcccagaaaaccttccaaggcatggtacagtaggactaatcactgtaactgatcctgatt  2640
            ||||||||||||||||||||||||||||||||||||||||||||||||||||||||||||
V.5:  2581  tcccagaaaaccttccaaggcatggtacagtaggactaatcactgtaactgatcctgatt  2640

V.1:  2641  atggagacaattctgcagttacgctctccatttagatgagaatgatgacttcaccattg  2700
            ||||||||||||||||||||||||||||||||||||||||||||||||||||||||||||
V.5:  2641  atggagacaattctgcagttacgctctccatttagatgagaatgatgacttcaccattg  2700

V.1:  2701  attcacaaactggtgtcatccgaccaaatatttcatttgatagagaaaaacaagaatctt  2760
            ||||||||||||||||||||||||||||||||||||||||||||||||||||||||||||
V.5:  2701  attcacaaactggtgtcatccgaccaaatatttcatttgatagagaaaaacaagaatctt  2760

V.1:  2761  acactttctatgtaaaggctgaggatggtggtagagtatcacgttcttcaagtgccaaag  2820
            ||||||||||||||||||||||||||||||||||||||||||||||||||||||||||||
V.5:  2761  acactttctatgtaaaggctgaggatggtggtagagtatcacgttcttcaagtgccaaag  2820

V.1:  2821  taaccataaatgtggttgatgtcaatgacaacaaaccagttttcattgtccctccttcca  2880
            ||||||||||||||||||||||||||||||||||||||||||||||||||||||||||||
V.5:  2821  taaccataaatgtggttgatgtcaatgacaacaaaccagttttcattgtccctccttcca  2880

V.1:  2881  actgttcttatgaattggttctaccgtccactaatccaggcacagtggtctttcaggtaa  2940
            ||||||||||||||||||||||||||||||||||||||||||||||||||||||||||||
V.5:  2881  actgttcttatgaattggttctaccgtccactaatccaggcacagtggtctttcaggtaa  2940

V.1:  2941  ttgctgttgacaatgacactggcatgaatgcagaggttcgttacagcattgtaggaggaa  3000
            ||||||||||||||||||||||||||||||||||||||||||||||||||||||||||||
V.5:  2941  ttgctgttgacaatgacactggcatgaatgcagaggttcgttacagcattgtaggaggaa  3000

V.1:  3001  acacaagagatctgtttgcaatcgaccaagaaacaggcaacataacattgatggagaaat  3060
            ||||||||||||||||||||||||||||||||||||||||||||||||||||||||||||
V.5:  3001  acacaagagatctgtttgcaatcgaccaagaaacaggcaacataacattgatggagaaat  3060

V.1:  3061  gtgatgttacagaccttggtttacacagagtgttggtcaaagctaatgacttaggacagc  3120
            ||||||||||||||||||||||||||||||||||||||||||||||||||||||||||||
V.5:  3061  gtgatgttacagaccttggtttacacagagtgttggtcaaagctaatgacttaggacagc  3120
```

TABLE LIII(d)-continued

Nucleotide sequence alignment of 109P1D4 v.1 (SEQ ID NO: 256) and 109P1D4 v.5 (SEQ ID NO: 257) Score = 7456 bits (3878), Expect = 0.0 Identities = 3878/3878 (100%) Strand = Plus/Plus

```
V.1:  3121  ctgattctctcttcagtgttgtaattgtcaatctgttcgtgaatgagtcggtgaccaatg  3180
            ||||||||||||||||||||||||||||||||||||||||||||||||||||||||||||
V.5:  3121  ctgattctctcttcagtgttgtaattgtcaatctgttcgtgaatgagtcggtgaccaatg  3180

V.1:  3181  ctacactgattaatgaactggtgcgcaaaagcactgaagcaccagtgaccccaaatactg  3240
            ||||||||||||||||||||||||||||||||||||||||||||||||||||||||||||
V.5:  3181  ctacactgattaatgaactggtgcgcaaaagcactgaagcaccagtgaccccaaatactg  3240

V.1:  3241  agatagctgatgtatcctcaccaactagtgactatgtcaagatcctggttgcagctgttg  3300
            ||||||||||||||||||||||||||||||||||||||||||||||||||||||||||||
V.5:  3241  agatagctgatgtatcctcaccaactagtgactatgtcaagatcctggttgcagctgttg  3300

V.1:  3301  ctggcaccataactgtcgttgtagttattttcatcactgctgtagtaagatgtcgccagg  3360
            ||||||||||||||||||||||||||||||||||||||||||||||||||||||||||||
V.5:  3301  ctggcaccataactgtcgttgtagttattttcatcactgctgtagtaagatgtcgccagg  3360

V.1:  3361  caccacaccttaaggctgctcagaaaaacaagcagaattctgaatgggctaccccaaacc  3420
            ||||||||||||||||||||||||||||||||||||||||||||||||||||||||||||
V.5:  3361  caccacaccttaaggctgctcagaaaaacaagcagaattctgaatgggctaccccaaacc  3420

V.1:  3421  cagaaaacaggcagatgataatgatgaagaaaaagaaaaagaagaagaagcattcccta   3480
            ||||||||||||||||||||||||||||||||||||||||||||||||||||||||||||
V.5:  3421  cagaaaacaggcagatgataatgatgaagaaaaagaaaaagaagaagaagcattcccta   3480

V.1:  3481  agaacttgctgcttaattttgtcactattgaagaaactaaggcagatgatgttgacagtg  3540
            ||||||||||||||||||||||||||||||||||||||||||||||||||||||||||||
V.5:  3481  agaacttgctgcttaattttgtcactattgaagaaactaaggcagatgatgttgacagtg  3540

V.1:  3541  atggaaacagagtcacactagaccttcctattgatctagaagagcaaacaatgggaaagt  3600
            ||||||||||||||||||||||||||||||||||||||||||||||||||||||||||||
V.5:  3541  atggaaacagagtcacactagaccttcctattgatctagaagagcaaacaatgggaaagt  3600

V.1:  3601  acaattgggtaactacacctactactttcaagcccgacagccctgatttggcccgacact  3660
            ||||||||||||||||||||||||||||||||||||||||||||||||||||||||||||
V.5:  3601  acaattgggtaactacacctactactttcaagcccgacagccctgatttggcccgacact  3660

V.1:  3661  acaaatctgcctctccacagcctgccttccaaattcagcctgaaactcccctgaattcga  3720
            ||||||||||||||||||||||||||||||||||||||||||||||||||||||||||||
V.5:  3661  acaaatctgcctctccacagcctgccttccaaattcagcctgaaactcccctgaattcga  3720

V.1:  3721  agcaccacatcatccaagaactgcctctcgataacacctttgtggcctgtgactctatct  3780
            ||||||||||||||||||||||||||||||||||||||||||||||||||||||||||||
V.5:  3721  agcaccacatcatccaagaactgcctctcgataacacctttgtggcctgtgactctatct  3780

V.1:  3781  ccaagtgttcctcaagcagttcagatccctacagcgtttctgactgtggctatccagtga  3840
            ||||||||||||||||||||||||||||||||||||||||||||||||||||||||||||
V.5:  3781  ccaagtgttcctcaagcagttcagatccctacagcgtttctgactgtggctatccagtga  3840

V.1:  3841  cgaccttcgaggtacctgtgtccgtacacaccagaccg                        3878
            ||||||||||||||||||||||||||||||||||||||
V.5:  3841  cgaccttcgaggtacctgtgtccgtacacaccagaccg                        3878
```

TABLE LIV(d)

Peptide sequences of protein coded by 109P1D4 v.5 (SEQ ID NO: 258)

| | | | | | |
|---|---|---|---|---|---|
| MDLLSGTYIF | AVLLACVVFH | SGAQEKNYTI | REEMPENVLI | GDLLKDLNLS | LIPNKSLTTA | 60 |
| MQFKLVYKTG | DVPLIRIEED | TGEIFTTGAR | IDREKLCAGI | PRDEHCFYEV | EVAILPDEIF | 120 |
| RLVKIRFLIE | DINDNAPLFP | ATVINISIPE | NSAINSKYTL | PAAVDPDVGI | NGVQNYELIK | 180 |
| SQNIFGLDVI | ETPEGDKMPQ | LIVQKELDRE | EKDTYVMKVK | VEDGGFPQRS | STAILQVSVT | 240 |
| DTNDNHPVFK | ETEIEVSIPE | NAPVGTSVTQ | LHATADADIGE | NAKIHFSFSN | LVSNIARRLF | 300 |
| HLNATTGLIT | IKEPLDREET | PNMKLLVLAS | DGGLMPARAM | VLVNVTDVND | NVPSIDIRYI | 360 |
| VNPVNDTVVL | SENIPLNTKI | ALITVTDKDA | DHNGRVTCFT | DHEIPFRLRP | VFSNQFLLET | 420 |

TABLE LIV(d)-continued

Peptide sequences of protein coded by 109P1D4 v.5 (SEQ ID NO: 258)

```
AAYLDYESTK EYAIKLLAAD AGKPPLNQSA MLFIKVKDEN DNAPVFTQSF VTVSIPENNS    480
PGIQLTKVSA MDADSGPNAK INYLLGPDAP PEFSLDCRTG MLTVVKKLDR EKEDKYLFTI    540
LAKDNGVPPL TSNVTVFVSI IDQNDNSPVF THNEYNFYVP ENLPRHGTVG LITVTDPDYG    600
DNSAVTLSIL DENDDFTIDS QTGVIRPWIS FDREKQESYT FYVKAEDGGR VSRSSSAKVT    660
INVVDVNDNK PVFIVPPSNC SYELVLPSTN PGTVVFQVIA VDNDTGMNAE VRYSIVGGNT    720
RDLFAIDQET GNITLMEKCD VTDLGLHRVL VKANDLGQPD SLFSVVIVNL FVNESVTNAT    780
LINELVRKST EAPVTPNTEI ADVSSPTSDY VKILVAAVAG TITVVVVIFI TAVVRCRQAP    840
HLKAAQKNKQ NSEWATPWPE NRQMIMMKKK KKKKKHSPKN LLLNFVTIEE TKADDVDSDG    900
NRVTLDLPID LEEQTMGKYN WVTTPTTFKP DSPDLARHYK SASPQPAFQI QPETPLNSKH    960
HIIQELPLDN TFVACDSISK CSSSSSDPYS VSDCGYPVTT FEVPVSVHTR PSQRRVTFHL   1020
PEGSQESSSD GGLGDHDAGS LTSTSHGLPL GYPQEEYFDR ATPSNRTEGD GNSDPESTFI   1080
PGLKKAAEIT VQPTVEEASD NCTQECLIYG HSDACWMPAS LDHSSSSQAQ ASALCHSPPL   1140
SQASTQHHSP RVTQTIALCH SPPVTQTIAL CHSPPPIQVS ALHHSPPLVQ ATALHHSPPS   1200
AQASALCYSP PLAQAAAISH SSPLPQVIAL HRSQAQSSVS LQQGWVQGAD GLCSVDQGVQ   1260
GSATSQFYTM SERLHPSDDS IKVIPLTTFT PRQQARPSRG DSPIMEEHPL              1310
```

TABLE LV(d)

Amino acid sequence alignment of 109P1D4 v.1 (SEQ ID NO: 259) and 109P1D4 v.5 (SEQ ID NO: 260) Score = 2005 bits (5195), Expect = 0.0 Identities = 1011/1011 (100%), Positives = 1011/1011 (100%)

```
V.1   1 MDLLSGTYIFAVLLACVVFHSGAQEKNYTIREEMPENVLIGDLLKDLNLSLIPNKSLTTA  60
        MDLLSGTYIFAVLLACVVFHSGAQEKNYTIREEMPENVLIGDLLKDLNLSLIPNKSLTTA
V.5   1 MDLLSGTYIFAVLLACVVFHSGAQEKNYTIREEMPENVLIGDLLKDLNLSLIPNKSLTTA  60

V.1  61 MQFKLVYKTGDVPLIRIEEDTGEIFTTGARIDREKLCAGIPRDEHCFYEVEVAILPDEIF 120
        MQFKLVYKTGDVPLIRIEEDTGEIFTTGARIDREKLCAGIPRDEHCFYEVEVAILPDEIF
V.5  61 MQFKLVYKTGDVPLIRIEEDTGEIFTTGARIDREKLCAGIPRDEHCFYEVEVAILPDEIF 120

V.1 121 RLVKIRFLIEDINDNAPLFPATVINISIPENSAINSKYTLPAAVDPDVGINGVQNYELIK 180
        RLVKIRFLIEDINDNAPLFPATVINISIPENSAINSKYTLPAAVDPDVGINGVQNYELIK
V.5 121 RLVKIRFLIEDINDNAPLFPATVINISIPENSAINSKYTLPAAVDPDVGINGVQNYELIK 180

V.1 181 SQNIFGLDVIETPEGDKMPQLIVQKELDREEKDTYVMKVKVEDGGFPQRSSTAILQVSVT 240
        SQNIFGLDVIETPEGDKMPQLIVQKELDREEKDTYVMKVKVEDGGFPQRSSTAILQVSVT
V.5 181 SQNIFGLDVIETPEGDKMPQLIVQKELDREEKDTYVMKVKVEDGGFPQRSSTAILQVSVT 240

V.1 241 DTNDNHPVFKETEIEVSIPENAPVGTSVTQLHATDADIGENAKIHFSFSNLVSNIARRLF 300
        DTNDNHPVFKETEIEVSIPENAPVGTSVTQLHATDADIGENAKIHFSFSNLVSNIARRLF
V.5 241 DTNDNHPVFKETEIEVSIPENAPVGTSVTQLHATDADIGENAKIHFSFSNLVSNIARRLF 300

V.1 301 HLNATTGLITIKEPLDREETPNHKLLVLASDGGLMPARAMVLVNVTDVNDNVPSIDIRYI 360
        HLNATTGLITIKEPLDREETPNHKLLVLASDGGLMPARAMVLVNVTDVNDNVPSIDIRYI
V.5 301 HLNATTGLITIKEPLDREETPNHKLLVLASDGGLMPARAMVLVNVTDVNDNVPSIDIRYI 360

V.1 361 VNPVNDTVVLSENIPLNTKIALITVTDKDADHNGRVTCFTDHEIPFRLRPVFSNQFLLET 420
        VNPVNDTVVLSENIPLNTKIALITVTDKDADHNGRVTCFTDHEIPFRLRPVFSNQFLLET
V.5 361 VNPVNDTVVLSENIPLNTKIALITVTDKDADHNGRVTCFTDHEIPFRLRPVFSNQFLLET 420

V.1 421 AAYLDYESTKEYAIKLLAADAGKPPLNQSAMLFIKVKDENDNAPVFTQSFVTVSIPENNS 480
        AAYLDYESTKEYAIKLLAADAGKPPLNQSAMLFIKVKDENDNAPVFTQSFVTVSIPENNS
V.5 421 AAYLDYESTKEYAIKLLAADAGKPPLNQSAMLFIKVKDENDNAPVFTQSFVTVSIPENNS 480

V.1 481 PGIQLTKVSAMDADSGPNAKINYLLGPDAPPEFSLDCRTGMLTVVKKLDREKEDKYLFTI 540
        PGIQLTKVSAMDADSGPNAKINYLLGPDAPPEFSLDCRTGMLTVVKKLDREKEDKYLFTI
V.5 481 PGIQLTKVSAMDADSGPNAXINYLLGPDAPPEFSLDCRTGMLTVVKKLDREKEDKYLFTI 540

V.1 541 LAKDNGVPPLTSNVTVFVSIIDQNDNSPVFTHNEYNFYVPENLPRHGTVGLITVTDPDYG 600
        LAKDNGVPPLTSNVTVFVSIIDQNDNSPVFTHNEYNFYVPENLPRHGTVGLITVTDPDYG
V.5 541 LAKDNGVPPLTSNVTVFVSIIDQNDNSPVFTHNEYNFYVPENLPRHGTVGLITVTDPDYG 600
```

TABLE LV(d)-continued

Amino acid sequence alignment of 109P1D4 v.1 (SEQ ID NO: 259) and 109P1D4 v.5 (SEQ ID NO: 260) Score = 2005 bits (5195), Expect = 0.0Identities = 1011/1011 (100%), Positives = 1011/1011 (100%)

```
V.1 601 DNSAVTLSILDENDDFTIDSQTGVIRPNISFDREKQESYTFYVKAEDGGRVSRSSSAKVT 660
        DNSAVTLSILDENDDFTIDSQTGVIRPNISFDREKQESYTFYVKAEDGGRVSRSSSAKVT
V.5 601 DNSAVTLSILDENDDFTIDSQTGVIRPNISFDREKQESYTFYVKAEDGGRVSRSSSAKVT 660

V.1 661 INVVDVNDNKPVFIVPPSNCSYELVLPSTNPGTVVFQVIAVDNDTGMNAEVRYSIVGGNT 720
        INVVDVNDNKPVFIVPPSNCSYELVLPSTNPGTVVFQVIAVDNDTGMNAEVRYSIVGGNT
V.5 661 INVVDVNDNKPVFIVPPSNCSYELVLPSTNPGTVVFQVIAVDNDTGMNAEVRYSIVGGNT 720

V.1 721 RDLFAIDQETGNITLMEKCDVTDLGLHRVLVKANDLGQPDSLFSVVIVNLFVNESVTNAT 780
        RDLFAIDQETGNITLMEKCDVTDLGLHRVLVKANDLGQPDSLFSVVIVNLFVNESVTNAT
V.5 721 RDLFAIDQETGNITLMEKCDVTDLGLHRVLVKANDLGQPDSLFSVVIVNLFVNESVTNAT 780

V.1 781 LINELVRKSTEAPVTPNTEIADVSSPTSDYVKILVAAVAGTITVVVVIFITAVVRCRQAP 840
        LINELVRKSTEAPVTPNTEIADVSSPTSDYVKILVAAVAGTITVVVVIFITAVVRCRQAP
V.5 781 LINELVRKSTEAPVTPNTEIADVSSPTSDYVKILVAAVAGTITVVVVIFITAVVRCRQAP 840

V.1 841 KLKAAQKNKQNSEWATPNPENRQMIMMKKKKKKKKHSPKNLLLNFVTIEETKADDVDSGD 900
         HLKAAQKNKQNSEWATPNPENRQMIMMKKKKKKKKHSPKNLLLNFVTIEETKADDVDSDG
V.5 841 HLKAAQKNKQNSEWATPNPENRQMIMMKKKKKKKKHSPKNLLLNFVTIEETKADDVDSDG 900

V.1 901 NRVTLDLPIDLEEQTMGKYNWVTTPTTFKPDSPDLARHYKSASPQPAFQIQPETPLNSKH 960
        NRVTLDLPIDLEEQTMGKYNWVTTPTTFKPDSPDLARHYKSASPQPAFQIQPETPLNSK
V.5 901 NRVTLDLPIDLEEQTMGKYNWVTTPTTFKPDSPDLARHYKSASPQPAFQIQPETPLNSKN 960

V.1 961 HIIQELPLDNTFVACDSISKCSSSSSDPYSVSDCGYPVTTFEVPVSVNTRP 1011
        HIIQELPLDNTFVACDSISKCSSSSSDPYSVSDCGYPVTTFEVPVSVHTRP
V.5 961 HIIQELPLDNTFVACDSISKCSSSSSDPYSVSDCGYPVTTFEVPVSVHTRP 1011
```

TABLE LII(e)

Nucleotide sequence of transcript variant 109P1D4 v.6 (SEQ ID NO: 261)

```
ggcagtcggc gaactgtctg gcgggagga gccgtgagca gtagctgcac tcagctgccc      60
gcgcggcaaa gaggaaggca agccaaacag agtgcgcaga gtggcagtgc cagcggcgac     120
acaggcagca caggcagccc gggctgcctg aatagcctca gaaacaacct cagcgactcc     180
ggctgctctg cggactgcga gctgtggcgg tagagcccgc tacagcagtc gcagtctccg     240
tggagcgggc ggaagccttt tttctcccct tcgtttacct cttcattcta ctctaaaggc     300
atcgttatta gagggtgctt aaaaagtaca gatcaactgg atggatgaat ggatggaaga     360
ggatggaata tcttaacaaa acacattttc cttaagtaaa ttcatgcata ctccaaataa     420
aatacagaat gtgaagtatc tctgaactgt gctgttgaat atggtagcta ctagctacat     480
gaaaatcctg ttgtgaataa aaggattcc acagatcaca taccgagcg ttttgcctc      540
agctgctctc aactttgtaa tcttgtgaag aagctgacaa gcttggctga ttgcagtgca     600
ctatgaggac tgaatgacag tgggttttaa ttcagatatt tcaagtgttg tgcgggttaa     660
tacaacaaac tgtcacaagt gtttgttgtc cgggacgtac attttcgcgg tcctgctagt     720
atgcgtggtg ttccactctg gcgcccagga gaaaaactac accatccgag aagaaattcc     780
atgcgtggtg ttccactctg gcgcccagga gaaaaactac accatccgag aagaaattcc     840
gtccttgaca actactatgc agttcaagct agtgtacaag accggagatg tgccactgat     900
tcgaattgaa gaggatactg gtgagatctt cactaccggc gctcgcattg atcgtgagaa     960
attatgtgct ggtatcccaa gggatgagca ttgcttttat gaagtggagg ttgccatttt    1020
gccggatgaa atatttagac tggttaagat acgttttctg atagaagata taatgataaa    1080
tgcaccattg ttcccagcaa cagttatcaa catatcaatt ccagagaact cggctataaa    1140
ctctaaatat actctcccag cggctgttga tcctgacgta ggcataaacg gagttcaaaa    1200
```

TABLE LII(e)-continued

| Nucleotide sequence of transcript variant 109P1D4 v.6 (SEQ ID NO: 261) | |
|---|---|
| ctacgaacta attaagagtc aaaacatttt tggcctcgat gtcattgaaa caccagaagg | 1260 |
| agacaagatg ccacaactga ttgttcaaaa ggagttagat agggaagaga aggataccta | 1320 |
| tgtgatgaaa gtaaaggttg aagatggtgg ctttcctcaa agatccagta ctgctatttt | 1380 |
| gcaagtaagt gttactgata caaatgacaa ccacccagtc tttaaggaga cagagattga | 1440 |
| agtcagtata ccagaaaatg ctcctgtagg cacttcagtg acacagctcc atgccacaga | 1500 |
| tgctgacata ggtgaaaatg ccaagatcca cttctctttc agcaatctag tctccaacat | 1560 |
| tgccaggaga ttatttcacc tcaatgccac cactggactt atcacaatca agaaccact | 1620 |
| ggatagggaa gaaacaccaa accacaagtt actggttttg gcaagtgatg gtggattgat | 1680 |
| gccagcaaga gcaatggtgc tggtaaatgt tacagatgtc aatgataatg tcccatccat | 1740 |
| tgacataaga tacatcgtca atcctgtcaa tgacacagtt gttctttcag aaaatattcc | 1800 |
| actcaacacc aaaattgctc tcataactgt gacggataag gatgcggacc ataatggcag | 1860 |
| ggtgacatgc ttcacagatc atgaaattcc tttcagatta aggccagtat tcagtaatca | 1920 |
| gttcctcctg gagaatgcag catatcttga ctatgagtcc acaaaagaat atgccattaa | 1980 |
| attactggct gcagatgctg gcaaacctcc tttgaatcag tcagcaatgc tcttcatcaa | 2040 |
| agtgaaagat gaaaatgaca atgctccagt ttttcacccag tctttcgtaa ctgtttctat | 2100 |
| tcctgagaat aactctcctg gcatccagtt gatgaaagta agtgcaacgg atgcagacag | 2160 |
| tgggcctaat gctgagatca attacctgct aggccctgat gctccacctg aattcagcct | 2220 |
| ggatcgtcgt acaggcatgc tgactgtagt gaagaaaacta gatagagaaa aagaggataa | 2280 |
| atatttattc acaattctgg caaaagataa tggggtacca cccttaacca gcaatgtcac | 2340 |
| agtctttgta agcattattg atcagaatga caatagccca gttttcactc acaatgaata | 2400 |
| caaattctat gtcccagaaa accttccaag gcatggtaca gtaggactaa tcactgtaac | 2460 |
| tgatcctgat tatggagaca attctgcagt tacgctctcc attttagatg agaatgatga | 2520 |
| cttcaccatt gattcacaaa ctggtgtcat ccgaccaaat atttcatttg atagagaaaa | 2580 |
| acaagaatct tacactttct atgtaaaggc tgaggatggt ggtagagtat cacgttcttc | 2640 |
| aagtgccaaa gtaaccataa atgtggttga tgtcaatgac aacaaaccag ttttcattgt | 2700 |
| ccctccttac aactattctt atgaattggt tctaccgtcc actaatccag gcacagtggt | 2760 |
| ctttcaggta attgctgttg acaatgacac tggcatgaat gcagaggttc gttacagcat | 2820 |
| tgtaggagga aacacaagag atctgttttgc aatcgaccaa gaaacaggca acataacatt | 2880 |
| gatggagaaa tgtgatgtta cagaccttgg tttacacaga gtgttggtca agctaatga | 2940 |
| cttaggacag cctgattctc tcttcagtgt tgtaattgtc aatctgttcg tgaatgagtc | 3000 |
| agtgaccaat gctacactga ttaatgaact ggtgcgcaaa agcattgaag caccagtgac | 3060 |
| cccaaatact gagatagctg atgtatcctc accaactagt gactatgtca agatcctggt | 3120 |
| tgcagctgtt gctggcacca taactgtcgt tgtagttatt ttcatcactg ctgtagtaag | 3180 |
| atgtcgccag gcaccacacc ttaaggctgc tcagaaaaac atgcagaatt ctgaatgggc | 3240 |
| taccccaaac ccagaaaaca ggcagatgat aatgatgaag aaaagaaaa agaagaagaa | 3300 |
| gcattcccct aagaacctgc tgcttaattt tgtcactatt gaagaaacta aggcagatga | 3360 |
| tgttgacagt gatggaaaca gagtcacact agaccttcct attgatctag aagagcaaac | 3420 |
| aatgggaaag tacaattggg taactacacc tactactttc aagcctgaca gccctgattt | 3480 |
| ggcccgacac tacaaatctg cctctccaca gcctgccttc caaattcagc ctgaaactcc | 3540 |

TABLE LII(e)-continued

Nucleotide sequence of transcript variant 109P1D4 v.6 (SEQ ID NO: 261)

```
cctgaatttg aagcaccaca tcatccaaga actgcctctc gataacacct ttgtggcctg    3600
tgactctatc tccaagtgtt cctcaagcag ttcagatccc tacagcgttt ctgactgtgg    3660
ctatccagtg acaaccttcg aggtacctgt gtccgtacac accagaccga ctgattccag    3720
gacatgaact attgaaatct gcagtgagat gtaactttct aggaacaaca aaattccatt    3780
ccccttccaa aaaatttcaa tggattgtga tttcaaaatt aggctaagat cattaatttt    3840
gtaatctaga tttcccatta taaaagcaag caaaaatcat cttaaaaatg atgtcctagt    3900
gaaccttgtg ctttctttag ctgtaatctg gcaatggaaa tttaaaattt atggaagaga    3960
cagtgcagca caataacaga gtactctcat gctgtttctc tgtttgctct gaatcaacag    4020
ccatgatgta atataaggct gtcttggtgt atacacttat ggttaatata tcagtcatga    4080
aacatgcaat tacttgccct gtctgattgt tgaataatta aaacattatc ttccaggagt    4140
ttggaagtga gctgaactag ccaaactact ctctgaaagg tatccagggc aagagacatt    4200
tttaagaccc caaacaaaca aaaaacaaaa ccaaaacact ctggttcagt gttttgaaaa    4260
tattcactaa cataatattg ctgagaaaat cattttttatt acccaccact ctgcttaaaa    4320
gttgagtggg ccgggcgcgg tggctcacgc ctgtaatccc agcactttgg gaggccgagg    4380
cgggtggatc acgaggtcag gagattgaga ccatcctggc taacacggtg aaaccccatc    4440
tccactaaaa atacaaaaaa ttagcctggc gtggtggcgg gcgcctgtag tcccagctac    4500
tcgggaggct gaggcaggag aatagcgtga acccgggagg cggagcttgc agtgagccga    4560
gatggcgcca ctctgcactc cagcctgggg gacagagcaa gactctgtct caaaaagaaa    4620
aaaatgttca atgatagaaa ataattttac taggttttta tgttgattgt actcatggtg    4680
ttccactcct tttaattatt aaaaagttat ttttggggtg ggtgtggtgg ctcacaccgt    4740
aatcccagca ctttgggagg ccgaggtggg tggatcacct gaggtcagga gttcaagacc    4800
agtntggcca acatggcgaa accccgtttt                                     4830
```

TABLE LIII(e)

Nucleotide sequence alignment of 109P1D4 v.1 (SEQ ID NO: 262) and 109P1D4 v.6 (SEQ ID NO: 263)
Score = 5676 bits (2952), Expect = 0.0 Identities = 3002/3027 (99%) Strand = Plus/Plus

```
v.1:  852  ttgttgtccgggacgtacattttcgcggtcctgctagcatgcgtggtgttccactctggc   911
           ||||||||||||||||||||||||||||||||||||||| ||||||||||||||||||||
v.6:  683  ttgttgtccgggacgtacattttcgcggtcctgctagtatgcgtggtgttccactctggc   742 v.1:  912  gcccaggagaaaaactacaccatccgagaagaaatgccagaaaacgtcctgataggcgac   971
           |||||||||||||||||||||||||||||||||||| |||||||||||||||||||| ||
v.6:  743  gcccaggagaaaaactacaccatccgagaagaaattccagaaaacgtcctgataggcaac   802 v.1:  972  ttgttgaaagaccttaacttgtcgctgattccaaacaagtccttgacaactgctatgcag   1031
           |||||||||||||||||||||||||||||||||||| ||||||||||||||| |||||||
v.6:  803  ttgttgaaagaccttaacttgtcgctgattccaaacaagtccttgacaactactatgcag   862 v.1:  1032 ttcaagctagtgtacaagaccggagatgtgccactgattcgaattgaagaggatactggt   1091
           ||||||||||||||||||||||||||||||||||||||||||||||||||||||||||||
v.6:  863  ttcaagctagtgtacaagaccggagatgtgccactgattcgaattgaagaggatactggt   922 v.1:  1092 gagatcttcactactggcgctcgcattgatcgtgagaaattatgtgctggtatcccaagg   1151
           ||||||||||||| ||||||||||||||||||||||||||||||||||||||||||||||
v.6:  923  gagatcttcactaccggcgctcgcattgatcgtgagaaattatgtgctggtatcccaagg   982 v.1:  1152 gatgagcattgcttttatgaagtggaggttgccattttgccggatgaaatatttagactg   1211
           |||||||||||||||||||||||||||||||||||| |||||||||||||||||||||||
v.6:  982  gatgagcattgcttttatgaagtggaggttgccatttgccggatgaaatatttagactg   1042
```

TABLE LIII(e)-continued

Nucleotide sequence alignment of 109P1D4 v.1 (SEQ ID NO: 262) and 109P1D4 v.6 (SEQ ID NO: 263)
Score = 5676 bits (2952), Expect = 0.0 Identities = 3002/3027 (99%) Strand = Plus/Plus

```
v.1:  1212  gttaagatacgttttctgatagaagatataaatgataatgcaccattgttcccagcaaca  1271
            ||||||||||||||||||||||||||||||||||||||||||||||||||||||||||||
v.6:  1043  gttaagatacgttttctgatagaagatataaatgataatgcaccattgttcccagcaaca  1102

V.1:  1272  gttatcaacatatcaattccagagaactcggctataaactctaaatatactctcccagcg  1331
            ||||||||||||||||||||||||||||||||||||||||||||||||||||||||||||
V.6:  1103  gttatcaacatatcaattccagagaactcggctataaactctaaatatactctcccagcg  1162

V.1:  1332  gctgttgatcctgacgtaggaataaacggagttcaaaactacgaactaattaagagtcaa  1391
            ||||||||||||||||||||||||||||||||||||||||||||||||||||||||||||
V.6:  1163  gctgttgatcctgacgtaggaataaacggagttcaaaactacgaactaattaagagtcaa  1222

V.1:  1392  aacattttggcctcgatgtcattgaaacaccagaaggagacaagatgccacaactgatt  1451
            ||||||||||||||||||||||||||||||||||||||||||||||||||||||||||||
V.6:  1223  aacattttggcctcgatgtcattgaaacaccagaaggagacaagatgccacaactgatt  1282

V.1:  1452  gttcaaaaggagttagatagggaagagaaggatacctacgtgatgaaagtaaaggttgaa  1511
            |||||||||||||||||||||||||||||||||| ||||||||||||||||||||||||
V.6:  1283  gttcaaaaggagttagatagggaagagaaggatacctatgtgatgaaagtaaaggttgaa  1342

V.1:  1452  gatggtggctttcctcaaagatccagtactgctattttgcaagtgagtgttactgataca  1511
            |||||||||||||||||||||||||||||||||||||||||||||||| |||||||||||
V.6:  1283  gatggtggctttcctcaaagatccagtactgctattttgcaagtgagtattactgataca  1342

V.1:  1572  aatgacaaccacccagtctttaaggagacagagattgaagtcagtataccagaaaatgct  1631
            |||||||||||||||||||||||||||||||||||||||| ||||||| |||||||||||
V.6:  1403  aatgacaaccacccagtctttaaggagacagagattgaagtcagtataccagaaaatgct  1462

V.1:  1632  cctgtaggcacttcagtgacacagctccatgccacagatgctgacataggtgaaaatgcc  1691
            |||||||||||||||||||||||||||||||||||||||| ||||||| |||||||||||
V.6:  1463  cctgtaggcacttcagtgacacagctccatgccacagatgctgacataggtgaaaatgcc  1522

V.1:  1692  aagatccacttctctttcagcaatctagtctccaacattgccaggagattatttcacctc  1751
            ||||||||||||||||||||||||||||||||||||||||||||||||||||||||||||
V.6:  1523  aagatccacttctctttcagcaatctagtctccaacattgccaggagattatttcacctc  1582

V.1:  1752  aatgccaccactggacttatcacaatcaaagaaccactggatagggaagaaacaccaaac  1811
            ||||||||||||||||||||||||||||||||||||||||||||||||||||||||||||
V.6:  1583  aatgccaccactggacttatcacaatcaaagaaccactggatagggaagaaacaccaaac  1642

V.1:  1812  cacaagttactggttttggcaagtgatggtggattgatgccagcaagagcaatggtgctg  1871
            ||||||||||||||||||||||||||||||||||||||||||||||||||||||||||||
V.6:  1643  cacaagttactggttttggcaagtgatggtggattgatgccagcaagagcaatggtgctg  1702

V.1:  1872  gtaaatgttacagatgtcaatgataatgtcccatccattgacataagatacatcgtcaat  1931
            ||||||||||||||||||||||||||||||||||||||||||||||||||||||||||||
V.6:  1703  gtaaatgttacagatgtcaatgataatgtcccatccattgacataagatacatcgtcaat  1762

V.1:  1932  cctgtcaatgacacagttgttctttcagaaaatattccactcaacaccaaaattgctctc  1991
            ||||||||||||||||||||||||||||||||||||||||||||||||||||||||||||
V.6:  1763  cctgtcaatgacacagttgttctttcagaaaatattccactcaacaccaaaattgctctc  1822

V.1:  1992  ataactgtgacggataaggatgcggaccataatggcagggtgacatgcttcacagatcat  2051
            ||||||||||||||||||||||||||||||||||||||||||||||||||||||||||||
V.6:  1823  ataactgtgacggataaggatgcggaccataatggcagggtgacatgcttcacagatcat  1882

V.1:  2052  gaaatcccttcagattaaggccagtattcagtaatcagttcctcctggagactgcagca  2111
            |||| |||||||||||||||||||||||||||||||||||||||||| |||| |||||||
V.6:  1883  gaaattcctttcagattaaggccagtattcagtaatcagttcctcctggagaatgcagca  1942

V.1:  2112  tatcttgactatgagtccacaaaagaatatgccattaaattactggctgcagatgctggc  2171
            ||||||||||||||||||||||||||||||||||||||||||||||||||||||||||||
V.6:  1943  tatcttgactatgagtccacaaaagaatatgccattaaattactggctgcagatgctggc  2002

V.1:  2172  aaacctcctttgaatcagtcagcaatgctcttcatcaaagtgaaagatgaaaatgacaat  2231
            ||||||||||||||||||||||||||||||||||||||||||||||||||||||||||||
V.6:  2003  aaacctcctttgaatcagtcagcaatgctcttcatcaaagtgaaagatgaaaatgacaat  2062

V.1:  2232  gctccagttttcacccagtctttcgtaactgtttctattcctgagaataactctcctggc  2291
            |||||||||||||||||||||||||||||||||||||||||||||||||||||||||||
V.6:  2063  gctccagttttcacccagtctttcgtaactgtttctattcctgagaataactctcctggc  2122

V.1:  2292  atccagttgacgaaagtaagtgcaatggatgcagacagtgggcctaatgctaagatcaat  2351
            |||||||||| ||||||||||||| || |||||||||||||||||||||||| |||||||
V.6:  2123  atccagttgatgaaagtaagtgcaacggatgcagacagtgggcctaatgctgagatcaat  2182
```

TABLE LIII(e)-continued

Nucleotide sequence alignment of 109P1D4 v.1 (SEQ ID NO: 262) and 109P1D4 v.6 (SEQ ID NO: 263)
Score = 5676 bits (2952), Expect = 0.0 Identities = 3002/3027 (99%) Strand = Plus/Plus

```
V.1:  2352  tacctgctaggccctgatgctccacctgaattcagcctggattgtcgtacaggcatgctg  2411
            ||||||||||||||||||||||||||||||||||||||||| |||||||||||||||||
V.6:  2183  tacctgctaggccctgatgctccacctgaattcagcctggatcgtcgtacaggcatgctg  2242

V.1:  2412  actgtagtgaagaaactagatagagaaaaagaggataaatatttattcacaattctggca  2471
            ||||||||||||||||||||||||||||||||||||||||||||||||||||||||||||
V.6:  2243  actgtagtgaagaaactagatagagaaaaagaggataaatatttattcacaattctggca  2302

V.1:  2472  aaagataacggggtaccacccttaaccagcaatgtcacagtctttgtaagcattattgat  2531
            |||||||| ||||||||||||||||||||||||||||||||||||||||||||||||||
V.6:  2303  aaagataatggggtaccacccttaaccagcaatgtcacagtctttgtaagcattattgat  2362

V.1:  2532  cagaatgacaatagcccagttttcactcacaatgaatacaacttctatgtcccagaaaac  2591
            ||||||||||||||||||||||||||||||||||||||||| ||||||||||||||||||
V.6:  2363  cagaatgacaatagcccagttttcactcacaatgaatacaaattctatgtcccagaaaac  2422

V.1:  2592  cttccaaggcatggtacagtaggactaatcactgtaactgatcctgattatggagacaat  2651
            ||||||||||||||||||||||||||||||||||||||||||||||||||||||||||||
V.6:  2423  cttccaaggcatggtacagtaggactaatcactgtaactgatcctgattatggagacaat  2482

V.1:  2652  tctgcagttacgctctccatttagatgagaatgatgacttcaccattgattcacaaact  2711
            ||||||||||||||||||||||||||||||||||||||||||||||||||||||||||||
V.6:  2483  tctgcagttacgctctccatttagatgagaatgatgacttcaccattgattcacaaact  2542

V.1:  2712  ggtgtcatccgaccaaatatttcatttgatagagaaaaacaagaatcttacactttctat  2771
            ||||||||||||||||||||||||||||||||||||||||||||||||||||||||||||
V.6:  2543  ggtgtcatccgaccaaatatttcatttgatagagaaaaacaagaatcttacactttctat  2602

V.1:  2772  gtaaaggctgaggatggtggtagagtatcacgttcttcaagtgccaaagtaaccataaat  2831
            ||||||||||||||||||||||||||||||||||||||||||||||||||||||||||||
V.6:  2603  gtaaaggctgaggatggtggtagagtatcacgttcttcaagtgccaaagtaaccataaat  2662

V.1:  2832  gtggttgatgtcaatgacaacaaaccagttttcattgtccctccttccaactgttcttat  2891
            ||||||||||||||||||||||||||||||||||||||||||||||||||| |||||||
V.6:  2663  gtggttgatgtcaatgacaacaaaccagttttcattgtccctccttacaactattcttat  2722

V.1:  2892  gaattggttctaccgtccactaatccaggcacagtggtctttcaggtaattgctgttgac  2951
            ||||||||||||||||||||||||||||||||||||||||||||||||||||||||||||
V.6:  2723  gaattggttctaccgtccactaatccaggcacagtggtctttcaggtaattgctgttgac  2782

V.1:  2952  aatgacactggcatgaatgcagaggttcgttacagcattgtaggaggaaacacaagagat  3011
            ||||||||||||||||||||||||||||||||||||||||||||||||||||||||||||
V.6:  2783  aatgacactggcatgaatgcagaggttcgttacagcattgtaggaggaaacacaagagat  2842

V.1:  3012  ctgtttgcaatcgaccaagaaacaggcaacataacattgatggagaaatgtgatgttaca  3071
            ||||||||||||||||||||||||||||||||||||||||||||||||||||||||||||
V.6:  2843  ctgtttgcaatcgaccaagaaacaggcaacataacattgatggagaaatgtgatgttaca  2902

V.1:  3072  gaccttggtttacacagagtgttggtcaaagctaatgacttaggacagcctgattctctc  3131
            ||||||||||||||||||||||||||||||||||||||||||||||||||||||||||||
V.6:  2903  gaccttggtttacacagagtgttggtcaaagctaatgacttaggacagcctgattctctc  2962

V.1:  3132  ttcagtgttgtaattgtcaatctgttcgtgaatgagtcggtgaccaatgctacactgatt  3191
            ||||||||||||||||||||||||||||||||||||||||||||| ||||||||||||||
V.6:  2963  ttcagtgttgtaattgtcaatctgttcgtgaatgagtcagtgaccaatgctacactgatt  3022

V.1:  3192  aatgaactggtgcgcaaaagcactgaagcaccagtgaccccaaatactgagatagctgat  3251
            ||||||||||||||||||||||||||||| ||||||||||||||||||||||||||||||
V.6:  3023  aatgaactggtgcgcaaaagcattgaagcaccagtgaccccaaatactgagatagctgat  3082

V.1:  3252  gtatcctcaccaactagtgactatgtcaagatcctggttgcagctgttgctggcaccata  3311
            ||||||||||||||||||||||||||||||||||||||||||||||||||||||||||||
V.6:  3083  gtatcctcaccaactagtgactatgtcaagatcctggttgcagctgttgctggcaccata  3142

V.1:  3312  actgtcgttgtagttattttcatcactgctgtagtaagatgtcgccaggcaccacacctt  3371
            ||||||||||||||||||||||||||||||||||||||||||||||||||||||||||||
V.6:  3143  actgtcgttgtagttattttcatcactgctgtagtaagatgtcgccaggcaccacacctt  3202

V.1:  3372  aaggctgctcagaaaaacaagcagaattctgaatgggctaccccaaacccagaaaacagg  3431
            |||||||||||||||||| |||||||||||||||||||||||||||||||||||||||||
V.6:  3203  aaggctgctcagaaaaacatgcagaattctgaatgggctaccccaaacccagaaaacagg  3262
```

TABLE LIII(e)-continued

Nucleotide sequence alignment of 109P1D4 v.1 (SEQ ID NO: 262) and 109P1D4 v.6 (SEQ ID NO: 263)
Score = 5676 bits (2952), Expect = 0.0 Identities = 3002/3027 (99%) Strand = Plus/Plus

```
V.1:  3432  cagatgataatgatgaagaaaagaaaaagaagaagaagcattcccctaagaacttgctg  3491
            ||||||||||||||||||||||||||||||||||||||||||||||||||||| ||||
V.6:  3263  cagatgataatgatgaagaaaagaaaaagaagaagaagcattcccctaagaacctgctg  3322

V.1:  3492  cttaattttgtcactattgaagaaactaaggcagatgatgttgacagtgatggaaacaga  3551
            ||||||||||||||||||||||||||||||||||||||||||||||||||||||||||||
V.6:  3323  cttaattttgtcactattgaagaaactaaggcagatgatgttgacagtgatggaaacaga  3382

V.1:  3552  gtcacactagaccttcctattgatctagaagagcaaacaatgggaaagtacaattgggta  3611
            ||||||||||||||||||||||||||||||||||||||||||||||||||||||||||||
V.6:  3383  gtcacactagaccttcctattgatctagaagagcaaacaatgggaaagtacaattgggta  3442

V.1:  3612  actacacctactactttcaagcccgacagccctgatttggcccgacactacaaatctgcc  3671
            |||||||||||||||||||||||| |||||||||||||||||||||||||||||||||||
V.6:  3443  actacacctactactttcaagcctgacagccctgatttggcccgacactacaaatctgcc  3502

V.1:  3672  tctccacagcctgccttccaaattcagcctgaaactcccctgaattcgaagcaccacatc  3731
            |||||||||||||||||||||||||||||||||||||||||||||| |||||||||||||
V.6:  3503  tctccacagcctgccttccaaattcagcctgaaactcccctgaatttgaagcaccacatc  3562

V.1:  3732  atccaagaactgcctctcgataacacctttgtggcctgtgactctatctccaagtgttcc  3791
            ||||||||||||||||||||||||||||||||||||||||||||||||||||||||||||
V.6:  3563  atccaagaactgcctctcgataacacctttgtggcctgtgactctatctccaagtgttcc  3622

V.1:  3792  tcaagcagttcagatccctacagcgtttctgactgtggctatccagtgacgaccttcgag  3851
            |||||||||||||||||||||||||||||||||||||||||||||||||||| |||||||
V.6:  3623  tcaagcagttcagatccctacagcgtttctgactgtggctatccagtgacaaccttcgag  3682

V.1:  3852  gtacctgtgtccgtacacaccagaccg                                   3878
            |||||||||||||||||||||||||||
V.6:  3683  gtacctgtgtccgtacacaccagaccg                                   3709
```

TABLE LIV(e)

Peptide sequences of protein coded by 109P1D4 v.6 (SEQ ID NO: 264)

| | | | | | |
|---|---|---|---|---|---|
| MTVGFNSDIS | SVVRVNTTNC | HKCLLSGTYI | FAVLLVCVVF | HSGAQEKNYT | IREEIPENVL | 60 |
| IGNLLKDLNL | SLIPNKSLTT | TMQFKLVYKT | GDVPLIRIEE | DTGEIFTTGA | RIDREKICAG | 120 |
| IPRDEHCFYE | VEVAILPDEI | FRLVKIRFLI | EDINDNAPLF | PATVINISIP | ENSAINSKYT | 180 |
| LPAAVDPDVG | INGVQNYELI | KSQNIFGLDV | IETPEGDKMP | QLIVQKELDR | EEKDTYVMKV | 240 |
| KVEDGGFPQR | SSTAILQVSV | TDTNDNHPVF | KETEIEVSIP | ENAPVGTSVT | QLHATDADIG | 300 |
| ENAKIHFSFS | NLVSNIARRL | FHLNATTGLI | TIKEPLDREE | TPNHKLLVLA | SDGGLMPARA | 360 |
| MVLVNVTDVN | DNVPSIDIRY | IVNPVNDTVV | LSENIPLNTK | IALITVTDKD | ADHNGRVTCF | 420 |
| TDHETPFRLR | PVFSNQFLLE | NAAYLDYEST | KEYAIKLLAA | DAGKPPLNQS | ANLFIKVKDE | 480 |
| NDNAPVFTQS | FVTVSIPENN | SPGTQLMKVS | ATDADSGPNA | EINYLLGPDA | PPEFSLDRRT | 540 |
| GMLTVVKKLD | REKEDKYLFT | ILAKDNGVPP | LTSNVTVFVS | IIDQNDNSPV | FTHNEYKFYV | 600 |
| PENLPRHGTV | GLITVTDPDY | GDNSAVTLSI | LDENDDFTID | SQTGVTRPNI | SFDREKQESY | 660 |
| TFYVKAEDGG | RVSRSSSAKV | TINVVDVNDN | KPVFIVPPYN | YSYELVLPST | NPGTVVFQVI | 720 |
| AVDNDTGMNA | EVRYSIVGGN | TRDLFAIDQE | TGNITLMEKC | DVTDLGLHRV | LVKANDLGQP | 780 |
| DSLFSVVIVN | LFVNESVTNA | TLINELVRKS | IEAPVTPNTE | IADVSSPTSD | YVKILVAAVA | 840 |
| GTITVVVVIF | ITAVVRCRQA | PHLKAAQKNN | QNSEWATPNP | ENRQMIMMKK | KKKKKHSPK | 900 |
| NLLLNFVTIE | ETKADDVDSD | GNRVTLDLPI | DLEEQTMGKY | NWVTTPTTFK | PDSPDLARHY | 960 |
| KSASPQPAFQ | IQPETPLNLK | HHIIQELPLD | NTFVACDSIS | KCSSSSSDPY | SVSDCGYPVT | 1020 |
| TFEVPVSVHT | RPTDSRT | | | | | 1037 |

TABLE LV(e)

Amino acid sequence alignment of 109P1D4 v.1 (SEQ ID NO: 265) and 109P1D4 v.6 (SEQ ID NO: 266) Score = 1966 bits (5093), Expect = 0.0 Identifies 994/1009 (98%), Positives = 997/1009 (98%)

```
V.1   3 LLSGTYIFAVLLACVVFHSGAQEKNYTIREEMPENVLIGDLLKDLNLSLIPNKSLTTAMQ  62
          LLSGTYIFAVLL CVVFHSGAQEKNYTIREE+PENVLIG LLKDLNLSLIPNKSLTT MQ
V.6  24 LLSGTYIFAVLLVCVVFHSGAQEKNYTIREEIPENVLIGNLLKDLNLSLIPNKSLTTTMQ  83

V.1  63 FKLVYKTGDVPLIRIEEDTGEIFTTGARIDREKLCAGIPRDEHCFYEVEVAILPDEIFRL 122
         FKLVYKTGDVPLIRIEEDTGEIFTTGARIDREKLCAGIPRDEHCFYEVEVAILPDEIFRL
V.6  84 FKLVYKTGDVPLIRIEEDTGEIFTTGARIDREKLCAGIPRDEHCFYEVEVAILPDEIFRL 143

V.1 123 VKIRFLIEDINDNAPLFPATVINISIPENSAINSKYTLPAAVDPDVGINGVQNYELIKSQ 182
         VKIRFLIEDINDNAPLFPATVINISIPENSAINSKYTLPAAVDPDVGINGVQNYELIKSQ
V.6 144 VKIRFLIEDINDNAPLFPATVINISIPENSAINSKYTLPAAVDPDVGINGVQNYELIKSQ 203

V.1 183 NIFGLDVIETPEGDKMPQLIVQKELDREEKDTYVMKVKVEDGGFPQRSSTAILQVSVTDT 242
         NIFGLDVIETPEGDKMPQLIVQKELDREEKDTYVMKVKVEDGGFPQRSSTAILQVSVTDT
V.6 204 NIFGLDVIETPEGDKMPQLIVQKELDREEKDTYVMKVKVEDGGFPQRSSTAILQVSVTDT 263

V.1 243 NDNHPVFKETEIEVSIPENAPVGTSVTQLHATDADIGENAKIHFSFSNLVSNIARRLFHL 302
         NDNHPVFKETEIEVSIPENAPVGTSVTQLHATDADIGENAKIHFSFSNLVSNIARRLFHL
V.6 264 NDNHPVFKETEIEVSIPENAPVGTSVTQLHATDADIGENAKIHFSFSNLVSNIARRLFHL 323

V.1 303 NATTGLITIKEPLDREETPNHKLLVLASDGGLMPARAMVLVNVTDVNDNVPSIDIRYIVN 362
         NATTGLITIKEPLDREETPNHKLLVLASDGGLMPARAMVLVNVTDVNDNVPSIDIRYIVN
V.6 324 NATTGLITIKEPLDREETPNHKLLVLASDGGLMPARAMVLVNVTDVNDNVPSIDIRYIVN 383

V.1 363 PVNDTVVLSENIPLNTKIALITVTDKDADHNGRVTCFTDHEIPFRLRPVFSNQFLLETAA 422
         PVNDTVVLSENIPLNTKIALITVTDKDADHNGRVTCFTDHEIPFRLRPVFSNQFLLE AA
V.6 384 PVNDTVVLSENIPLNTKIALITVTDKDADHNGRVTCFTDHEIPFRLRPVFSNQFLLENAA 443

V.1 423 YLDYESTKEYAIKLLAADAGKPPLNQSAMLFIKVKDENDNAPVFTQSFVTVSIPENNSPG 482
         YLDYESTKEYAIKLLAADAGKPPLNQSAMLFIKVKDENDNAPVFTQSFVTVSIPENNSPG
V.6 444 YLDYESTKEYAIKLLAADAGKPPLNQSAMLFIKVKDENDNAPVFTQSFVTVSIPENNSPG 503

V.1 483 IQLTKVSAMDADSGPNAKINYLLGPDAPPEFSLDCRTGMLTVVKKLDREKEDKYLFTILA 542
         IQL KVSA DADSGPNA+INYLLGPDAPPEFSLD RTGMLTVVKKLDREKEDKYLFTILA
V.6 504 IQLMKVSATDADSGPNAEINYLLGPDAPPEFSLDRRTGMLTVVKKLDREKEDKYLFTILA 563

V.1 543 KDNGVPPLTSNVTVFVSIIDQNDNSPVFTNNEYNFYVPENLPRMGTVGLITVTDPDYGDN 602
         KDNGVPPLTSNVTVFVSIIDQNDNSPVFTHNEY FYVPENLPRHGTVGLITVTDPDYGDN
V.6 564 KDNGVPPLTSNVTVFVSIIDQNDNSPVFTHNEYKFYVPENLPRHGTVGLITVTDPDYGDN 623

V.1 603 SAVTLSILDENDDFTIDSQTGVIRPNISFDREKQESYTFYVKAEDGGRVSRSSSAKVTIN 662
         SAVTLSILDENDDFTIDSQTGVIRPNISFDREKQESYTFYVKAEDGGRVSRSSSAKVTIN
V.6 624 SAVTLSILDENDDFTIDSQTGVIRPNISFDREKQESYTFYVKAEDGGRVSRSSSAKVTIN 683

V.1 663 VVDVNDNKPVFIVPPSNCSYELVLPSTNPGTVVFQVIAVDNDTGMNAEVRYSIVGGNTRD 722
         VVDVNDNKPVFIVPP N SYELVLPSTNPGTVVFQVIAVDNDTGMNAEVRYSIVGGNTRD
V.6 684 VVDVNDNKPVFIVPPYNYSYELVLPSTNPGTVVFQVIAVDNDTGMNAEVRYSIVGGNTRD 743

V.1 723 LFAIDQETGNITLMEKCDVTDLGLHRVLVKANDLGQPDSLFSVVIVNLFVNESVTNATLI 782
         LFAIDQETGNITLMEKCDVTDLGLHRVLVKANDLGQPDSLFSVVIVNLFVNESVTNATLI
V.6 744 LFAIDQETGNITLMEKCDVTDLGLHRVLVKANDLGQPDSLFSVVIVNLFVNESVTNATLI 803

V.1 783 NELVRKSTEAPVTPNTEIADVSSPTSDYVKILVAAVAGTITVVVVIFITAVVRCRQAPHL 842
         NELVRKS EAPVTPNTEIADVSSPTSDYVKILVAAVAGTITVVVVIFITAVVRCRQAPHL
V.6 804 NELVRKSIEAPVTPNTEIADVSSPTSDYVKILVAAVAGTITVVVVIFITAVVRCRQAPHL 863

V.1 843 KAAQKNKQNSEWATPNPENRQMIMNKKKKKKKKHSPKNLLLNFVTIEETKADDVDSDGNR 902
         KAAQKN QNSEWATPNPENRQM MNKKKKKKKKHSPKNLLLNFVTIEETKADDVDSDGNR
V.6 864 KAAQKNMQNSEWATPNPENRQMIMMKKKKKKKKHSPKNLLLNFVTIEETKADDVDSDGNR 923

V.1 903 VTLDLPIDLEEQTMGKYNWVTTPTTFKPDSPDLARHYKSASPQPAFQIQPETPLNSKHHI 962
         VTLDLPIDLEEQTMGKYNWVTTPTTFKPDSPDLARHYKSASPQPAFQIQPETPLN KHHI
V.6 924 VTLDLPIDLEEQTMGKYNWVTTPTTFKPDSPDLARHYKSASPQPAFQIQPETPLNLKHHI 983

V.1 963 IQELPLDNTFVACDSISKCSSSSSDPYSVSDCGYPVTTFEVPVSVHTRP 1011
         IQELPLDNT VACDSISKCSSSSSDPYSVSDCGYPVTTFEVPVSVHTRP
V.6 984 IQELPLDNTPVACDSISKCSSSSSDPYSVSDCGYPVTTFEVPVSVHTRP 1032
```

TABLE LII(f)

Nucleotide sequence of transcript variant 109P1D4 v.7 (SEQ ID NO: 267)

```
ggtggtccag tacctccaaa gatatggaat acactcctga aatatcctga aaccttttt    60 ttttcagaat cctttaataa gcagttatgt caatctgaaa gttgcttact tgtactttat  120
```

TABLE LII(f)-continued

Nucleotide sequence of transcript variant 109P1D4 v.7 (SEQ ID NO: 267)

| | | | | | |
|---|---|---|---|---|---|
| attaatagct | attcttgttt | ttcttatcca | aagaaaaatc | ctctaatccc | cttttcacat | 180 |
| gatagttgtt | accatgttta | ggcgttagtc | acatcaaccc | ctctcctctc | ccaaacttct | 240 |
| cttcttcaaa | tcaaacttta | ttagtccctc | ctttataatg | attccttgcc | tccttttatc | 300 |
| cagatcaatt | tttttcact | ttgatgccca | gagctgaaga | aatggactat | tgtataaatt | 360 |
| attcattgcc | aagagaataa | ttgcatttta | aacccatgtt | ataacaaaga | ataatgatta | 420 |
| tattttgtga | tttgtaacaa | atacccttta | ttttccctta | actattgaat | taaatatttt | 480 |
| aattatttgt | attctcttta | actatcttgg | tatattaaag | tattatcttt | tatatattta | 540 |
| tcaatggtgg | acacttttat | aggtactctg | tgtcattttt | gatactgtag | gtatcttatt | 600 |
| tcatttatct | ttattcttaa | tgtacgaatt | cataatattt | gattcagaac | agatttatca | 660 |
| ctaattaaca | gagtgtcaat | tatgctaaca | tctcatttac | tgattttaat | ttaaaacagt | 720 |
| ttttgttaac | atgcatgttt | agggttggct | tcttaataat | ttcttcttcc | tcttctctct | 780 |
| ctcctcttct | tttggtcagt | gttgtgcggg | ttaatacaac | aaactgtcac | aagtgtttgt | 840 |
| tgtccgggac | gtacattttc | gcggtcctgc | tagtatgcgt | ggtgttccac | tctggcgccc | 900 |
| aggagaaaaa | ctacaccatc | cgagaagaaa | ttccagaaaa | cgtcctgata | ggcaacttgt | 960 |
| tgaaagacct | taacttgtcg | ctgattccaa | acaagtcctt | gacaactact | atgcagttca | 1020 |
| agctagtgta | caagaccgga | gatgtgccac | tgattcgaat | tgaagaggat | actggtgaga | 1080 |
| tcttcactac | cggcgctcgc | attgatcgtg | agaaattatg | tgctggtatc | ccaagggatg | 1140 |
| agcattgctt | ttatgaagtg | gaggttgcca | ttttgccgga | tgaaatattt | agactggtta | 1200 |
| agatacgttt | tctgatagaa | gatataaatg | ataatgcacc | attgttccca | gcaacagtta | 1260 |
| tcaacatatc | aattccagag | aactcggcta | taaactctaa | atatactctc | ccagcggctg | 1320 |
| ttgatcctga | cgtaggcata | aacggagttc | aaaactacga | actaattaag | agtcaaaaca | 1380 |
| tttttggcct | cgatgtcatt | gaaacaccag | aaggagacaa | gatgccacaa | ctgattgttc | 1440 |
| aaaaggagtt | agatagggaa | gagaaggata | cctatgtgat | gaaagtaaag | gttgaagatg | 1500 |
| gtggctttcc | tcaaagatcc | agtactgcta | ttttgcaagt | aagtgttact | gatacaaatg | 1560 |
| acaaccaccc | agtctttaag | gagacagaga | ttgaagtcag | tataccagaa | aatgctcctg | 1620 |
| taggcacttc | agtgacacag | ctccatgcca | cagatgctga | cataggtgaa | aatgccaaga | 1680 |
| tccacttctc | tttcagcaat | ctagtctcca | acattgccag | gagattattt | cacctcaatg | 1740 |
| ccaccactgg | acttatcaca | atcaaagaac | cactggatag | ggaagaaaca | ccaaaccaca | 1800 |
| agttactggt | tttggcaagt | gatggtggat | tgatgccagc | aagagcaatg | gtgctggtaa | 1860 |
| atgttacaga | tgtcaatgat | aatgtcccat | ccattgacat | aagatacatc | gtcaatcctg | 1920 |
| tcaatgacac | agttgttctt | tcagaaaata | ttccactcaa | caccaaaatt | gctctcataa | 1980 |
| ctgtgacgga | taaggatgcg | gaccataatg | gcagggtgac | atgcttcaca | gatcatgaaa | 2040 |
| ttcctttcag | attaaggcca | gtattcagta | atcagttcct | cctggagaat | gcagcatatc | 2100 |
| ttgactatga | gtccacaaaa | gaatatgcca | ttaaattact | ggctgcagat | gctggcaaac | 2160 |
| ctcctttgaa | tcagtcagca | atgctcttca | tcaaagtgaa | agatgaaaat | gacaatgctc | 2220 |
| cagttttcac | ccagtctttc | gtaactgttt | ctattcctga | gaataactct | cctggcatcc | 2280 |
| agttgatgaa | agtaagtgca | acggatgcag | acagtgggcc | taatgctgag | atcaattacc | 2340 |
| tgctaggccc | tgatgctcca | cctgaattca | gcctggatcg | tcgtacaggc | atgctgactg | 2400 |
| tagtgaagaa | actagataga | gaaaagagg | ataaatattt | attcacaatt | ctggcaaaag | 2460 |

TABLE LII(f)-continued

Nucleotide sequence of transcript variant 109P1D4 v.7 (SEQ ID NO: 267)

| | | | | | |
|---|---|---|---|---|---|
| ataatggggt | accacccttta | accagcaatg | tcacagtctt | tgtaagcatt | attgatcaga | 2520 |
| atgacaatag | cccagttttc | actcacaatg | aatacaaatt | ctatgtccca | gaaaaccttc | 2580 |
| caaggcatgg | tacagtagga | ctaatcactg | taactgatcc | tgattatgga | gacaattctg | 2640 |
| cagttacgct | ctccatttta | gatgagaatg | atgacttcac | cattgattca | caaactggtg | 2700 |
| tcatccgacc | aaatatttca | tttgatagag | aaaaacaaga | atcttadact | ttctatgtaa | 2760 |
| aggctgagga | tggtggtaga | gtatcacgtt | cttcaagtgc | caaagtaacc | ataaatgtgg | 2820 |
| ttgatgtcaa | tgacaacaaa | ccagttttca | ttgtccctcc | ttacaactat | tcttatgaat | 2880 |
| tggttctacc | gtccactaat | ccaggcacag | tggtctttca | ggtaattgct | gttgacaatg | 2940 |
| acactggcat | gaatgcagag | gttcgttaca | gcattgtagg | aggaaacaca | agagatctgt | 3000 |
| ttgcaatcga | ccaagaaaca | ggcaacataa | cattgatgga | gaaatgtgat | gttacagacc | 3060 |
| ttggtttaca | cagagtgttg | gtcaaagcta | atgacttagg | acagcctgat | tctctcttca | 3120 |
| gtgttgtaat | tgtcaatctg | ttcgtgaatg | agtcagtgac | caatgctaca | ctgattaatg | 3180 |
| aactggtgcg | caaaagcatt | gaagcaccag | tgaccccaaa | tactgagata | gctgatgtat | 3240 |
| cctcaccaac | tagtgactat | gtcaagatcc | tggttgcagc | tgttgctggc | accataactg | 3300 |
| tcgttgtagt | tattttcatc | actgctgtag | taagatgtcg | ccaggcacca | cacccttaagg | 3360 |
| ctgctcagaa | aaacatgcag | aattctgaat | gggctacccc | aaacccagaa | aacaggcaga | 3420 |
| tgataatgat | gaagaaaaag | aaaaagaaga | agaagcattc | ccctaagaac | ctgctgctta | 3480 |
| atgttgtcac | tattgaagaa | actaaggcag | atgatgttga | cagtgatgga | aacagagtca | 3540 |
| cactagacct | tcctattgat | ctagaagagc | aaacaatggg | aaagtacaat | tgggtaacta | 3600 |
| cacctactac | tttcaagcct | gacagccctg | atttggcccg | acactacaaa | tctgcctctc | 3660 |
| cacagcctgc | cttccaaatt | cagcctgaaa | ctcccctgaa | tttgaagcac | cacatcatcc | 3720 |
| aagaactgcc | tctcgataac | acctttgtgg | cctgtgactc | tatctccaat | tgttcctcaa | 3780 |
| gcagttcaga | tccctacagc | gtttctgact | gtggctatcc | agtgacaacc | ttcgaggtac | 3840 |
| ctgtgtccgt | acacaecaga | ccgactgatt | ccaggacatg | aactattgaa | atctgcagtg | 3900 |
| agatgtaact | ttctaggaac | aacaaaattc | cattcccctt | ccaaaaaatt | tcaatgattg | 3960 |
| tgatttcaaa | attaggctaa | gatcattaat | tttgtaatct | agatttccca | ttataaaagc | 4020 |
| aagcaaaaat | catcttaaaa | atgatgtcct | agtgaaccct | gtgctttctt | tagctgtaat | 4080 |
| ctggcaatgg | aaatttaaaa | tttatggaag | agacagtgca | gcgcaataac | agagtactct | 4140 |
| catgctgttt | ctctgtttgc | tctgaatcaa | cagccatgat | gtaatataag | gctgtcttgg | 4200 |
| tgtatacact | tatggttaat | atatcagtca | tgaaacatgc | aattacttgc | cctgtctgat | 4260 |
| tgttgaataa | ttaaaacatt | atctccagga | gtttggaagt | gagctgaact | agccaaacta | 4320 |
| ctctctgaaa | ggtatccagg | gcaagagaca | tttttaagac | cccaaacaaa | caaaaaacaa | 4380 |
| aaccaaaaca | ctctggttca | gtgttttgaa | aatattgact | aacataatat | tgctgagaaa | 4440 |
| atcatttttta | ttacccacca | ctctgcttaa | aagttgagtg | ggccgggcgc | ggtggctcac | 4500 |
| gcctgtaatt | ccagcacttt | gggaggccga | ggcgggtgga | tcacgaggtc | aggatattga | 4560 |
| gaccatcctg | gctaacatgg | tgaaaccccca | tctccactaa | aaatacaaaa | aattagctgg | 4620 |
| gcgtggtggc | gggcgcctgt | agtcccagct | actcgggagg | ctgaggcagg | agaatggcgt | 4680 |
| gaacccggga | ggcggagctt | gcagtgagcc | gagatgcgc | cactgcactc | cagcctgggt | 4740 |
| gacagagcaa | gactctgtct | caaaaagaaa | aaaatgttca | gtgatagaaa | ataatttac | 4800 |

TABLE LII(f)-continued

Nucleotide sequence of transcript variant 109P1D4 v.7 (SEQ ID NO: 267)

```
taggtttttta tgttgattgt actcatgctg ttccactcct tttaattatt aaaaagttat   4860
ttttggctgg gtgtggtggc tcatacctgt aatcccagca ctttgggagg ccgaggctgg   4920
tggatcacct gaggtcagga gttcaagacc agtctggcca acat                     4964
```

TABLE LIII(f)

Nucleotide sequence alignment of 109P1D4 v.1 (SEQ ID NO: 268) and 109P1D4 v.7 (SEQ ID NO: 269)
Score = 5664 bits (2946), Expect = 0.0 Identities = 3000/3027 (99%) Strand = Plus / Plus

```
V.1:   852  ttgttgtccgggacgtacattttcgcggtcctgctagcatgcgtggtgttccactctggc   911
            ||||||||||||||||||||||||||||||||||||| ||||||||||||||||||||||
V.7:   837  ttgttgtccgggacgtacattttcgcggtcctgctagtatgcgtggtgttccactctggc   896

V.1:   912  gcccaggagaaaaactacaccatccgagaagaaatgccagaaaacgtcctgataggcgac   971
            ||||||||||||||||||||||||||||||||||| |||||||||||||||||||| ||
V.7:   897  gcccaggagaaaaactacaccatccgagaagaaattccagaaaacgtcctgataggcaac   956

V.1:   972  ttgttgaaagaccttaacttgtcgctgattccaaacaagtccttgacaactgctatgcag   1031
            |||||||||||||||||||||||||||||||||||||||||||||||||||| |||||||
V.7:   957  ttgttgaaagaccttaacttgtcgctgattccaaacaagtccttgacaactactatgcag   1016

V.1:  1032  ttcaagctagtgtacaagaccggagatgtgccactgattcgaattgaagaggatactggt   1091
            ||||||||||||||||||||||||||||||||||||||||||||||||||||||||||||
V.7:  1017  ttcaagctagtgtacaagaccggagatgtgccactgattcgaattgaagaggatactggt   1076

V.1:  1092  gagatcttcactactggcgctcgcattgatcgtgagaaattatgtgctggtatcccaagg   1151
            |||||||||||| |||||||||||||||||||||||||||||||||||||||||||||||
V.7:  1077  gagatcttcactaccggcgctcgcattgatcgtgagaaattatgtgctggtatcccaagg   1136

V.1:  1152  gatgagcattgcttttatgaagtggaggttgccattttgccggatgaaatatttagactg   1211
            ||||||||||||||||||||||||||||||||||||||||||||||||||||||||||||
V.7:  1137  gatgagcattgcttttatgaagtggaggttgccattttgccggatgaaatatttagactg   1966

V.1:  1212  gttaagatacgttttctgatagaagatataaatgataatgcaccattgttcccagcaaca   1271
            ||||||||||||||||||||||||||||||||||||||||||||||||||||||||||||
V.7:  1197  gttaagatacgttttctgatagaagatataaatgataatgcaccattgttcccagcaaca   1256

V.1:  1272  gttatcaacatatcaattccagagaactcggctataaaactctaaatatactctcccagcg   1331
            ||||||||||||||||||||||||||||||||||||||||||||||||||||||||||||
V.7:  1257  gttatcaacatatcaattccagagaactcggctataaaactctaaatatactctcccagcg   1316

V.1:  1332  gctgttgatcctgacgtaggaataaaacggagttcaaaactacgaactaattaagagtcaa   1391
            |||||||||||||||||||| |||||||||||||||||||||||||||||||||||||||
V.7:  1317  gctgttgatcctgacgtaggcataaaacggagttcaaaactacgaactaattaagagtcaa   1376

V.1:  1392  aacattttggcctcgatgtcattgaaacaccagaaggagacaagatgccacaactgatt   1451
            ||||||||||||||||||||||||||||||||||||||||||||||||||||||||||||
V.7:  1377  aacattttggcctcgatgtcattgaaacaccagaaggagacaagatgccacaactgatt   1436

V.1:  1452  gttcaaaaggagttagatagggaagagaaggatacctacgtgatgaaagtaaaggttgaa   1511
            |||||||||||||||||||||||||||||||||||| |||||||||||||||||||||||
V.7:  1437  gttcaaaaggagttagatagggaagagaaggatacctatgtgatgaaagtaaaggttgaa   1496

V.1:  1512  gatggtggctttcctcaaagatccagtactgctattttgcaagtgagtgttactgataca   1571
            |||||||||||||||||||||||||||||||||||||||||| |||||||||||||||||
V.7:  1497  gatggtggctttcctcaaagatccagtactgctattttgcaagtaagtgttactgataca   1556

V.1:  1572  aatgacaaccacccagtctttaaggagacagagattgaagtcagtataccagaaaatgct   1631
            ||||||||||||||||||||||||||||||||||||||||||||||||||||||||||||
V.7:  1557  aatgacaaccacccagtctttaaggagacagagattgaagtcagtataccagaaaatgct   1616

V.1:  1632  cctgtaggcacttcagtgacacagctccatgccacagatgctgacataggtgaaaatgcc   1691
            ||||||||||||||||||||||||||||||||||||||||||||||||||||||||||||
V.7:  1617  cctgtaggcacttcagtgacacagctccatgccacagatgctgacataggtgaaaatgcc   1676

V.1:  1692  aagatccacttctctttcagcaatctagtctccaacattgccaggagattatttcacctc   1751
            ||||||||||||||||||||||||||||||||||||||||||||||||||||||||||||
V.7:  1677  aagatccacttctctttcagcaatctagtctccaacattgccaggagattatttcacctc   1736
```

TABLE LIII(f)-continued

Nucleotide sequence alignment of 109P1D4 v.1 (SEQ ID NO: 268) and 109P1D4 v.7 (SEQ ID NO: 269)
Score = 5664 bits (2946), Expect = 0.0 Identities = 3000/3027 (99%) Strand = Plus / Plus

```
V.1:  1752  aatgccaccactggacttatcacaatcaaagaaccactggatagggaagaaacaccaaac  1811
            ||||||||||||||||||||||||||||||||||||||||||||||||||||||||||||
V.7:  1737  aatgccaccactggacttatcacaatcaaagaaccactggatagggaagaaacaccaaac  1796

V.1:  1812  cacaagttactggttttggcaagtgatggtggattgatgccagcaagagcaatggtgctg  1871
            ||||||||||||||||||||||||||||||||||||||||||||||||||||||||||||
V.7:  1797  cacaagttactggttttggcaagtgatggtggattgatgccagcaagagcaatggtgctg  1856

V.1:  1872  gtaaatgttacagatgtcaatgataatgtcccatccattgacataagatacatcgtcaat  1931
            ||||||||||||||||||||||||||||||||||||||||||||||||||||||||||||
V.7:  1857  gtaaatgttacagatgtcaatgataatgtcccatccattgacataagatacatcgtcaat  1916

V.1:  1932  cctgtcaatgacacagttgttctttcagaaaatattccactcaacaccaaaattgctctc  1991
            ||||||||||||||||||||||||||||||||||||||||||||||||||||||||||||
V.7:  1917  cctgtcaatgacacagttgttctttcagaaaatattccactcaacaccaaaattgctctc  1976

V.1:  1992  ataactgtgacggataaggatgcggaccataatggcagggtgacatgcttcacagatcat  2051
            ||||||||||||||||||||||||||||||||||||||||||||||||||||||||||||
V.7:  1977  ataactgtgacggataaggatgcggaccataatggcagggtgacatgcttcacagatcat  2036

V.1:  2052  gaaatccctttcagattaaggccagtattcagtaatcagttcctcctggagactgcagca  2111
            ||||| ||||||||||||||||||||||||||||||||||||||||||||||| ||||||
V.7:  2037  gaaattcctttcagattaaggccagtattcagtaatcagttcctcctggagaatgcagca  2096

V.1:  2112  tatcttgactatgagtccacaaaagaatatgccattaaattactggctgcagatgctggc  2171
            ||||||||||||||||||||||||||||||||||||||||||||||||||||||||||||
V.7:  2097  tatcttgactatgagtccacaaaagaatatgccattaaattactggctgcagatgctggc  2156

V.1:  2172  aaacctcctttgaatcagtcagcaatgctcttcatcaaagtgaaagatgaaaatgacaat  2231
            ||||||||||||||||||||||||||||||||||||||||||||||||||||||||||||
V.7:  2157  aaacctcctttgaatcagtcagcaatgctcttcatcaaagtgaaagatgaaaatgacaat  2216

V.1:  2232  gctccagttttcacccagtctttcgtaactgtttctattcctgagaataactctcctggc  2291
            ||||||||||||||||||||||||||||||||||||||||||||||||||||||||||||
V.7:  2217  gctccagttttcacccagtctttcgtaactgtttctattcctgagaataactctcctggc  2276

V.1:  2292  atccagttgacgaaagtaagtgcaatggatgcagacagtgggcctaatgctaagatcaat  2351
            ||||||||| |||||||||||| |||||||||||||||||||||||||||| ||||||||
V.7:  2277  atccagttgatgaaagtaagtgcaacggatgcagacagtgggcctaatgctgagatcaat  2336

V.1:  2352  tacctgctaggccctgatgctccacctgaattcagcctggattgtcgtacaggcatgctg  2411
            |||||||||||||||||||||||||||||||||||||||||| ||||||||||||||||
V.7:  2337  tacctgctaggccctgatgctccacctgaattcagcctggatcgtcgtacaggcatgctg  2396

V.1:  2412  actgtagtgaagaaactagatagagaaaaagaggataaatatttattcacaattctggca  2471
            ||||||||||||||||||||||||||||||||||||||||||||||||||||||||||||
V.7:  2397  actgtagtgaagaaactagatagagaaaaagaggataaatatttattcacaattctggca  2456

V.1:  2472  aaagataacggggtaccacccttaaccagcaatgtcacagtctttgtaagcattattgat  2531
            ||||||||  ||||||||||||||||||||||||||||||||||||||||||||||||||
V.7:  2457  aaagataatggggtaccacccttaaccagcaatgtcacagtctttgtaagcattattgat  2516

V.1:  2532  cagaatgacaatagcccagttttcactcacaatgaatacaacttctatgtcccagaaaac  2591
            |||||||||||||||||||||||||||||||||||||||||| ||||||||||||||||
V.7:  2517  cagaatgacaatagcccagttttcactcacaatgaatacaaattctatgtcccagaaaac  2576

V.1:  2592  cttccaaggcatggtacagtaggactaatcactgtaactgatcctgattatggagacaat  2651
            ||||||||||||||||||||||||||||||||||||||||||||||||||||||||||||
V.7:  2577  cttccaaggcatggtacagtaggactaatcactgtaactgatcctgattatggagacaat  2636

V.1:  2652  tctgcagttacgctctccatttagatgagaatgatgacttcaccattgattcacaaact  2711
            |||||||| |||||||||||||||||||||||||||||||||||||||||||||||||||
V.7:  2637  tctgcagttacgctctccatttagatgagaatgatgacttcaccattgattcacaaact  2696

V.1:  2712  ggtgtcatccgaccaaatatttcatttgatagagaaaaacaagaatcttacactttctat  2771
            ||||||||||||||||||||||||||||||||||||||||||||||||||||||||||||
V.7:  2697  ggtgtcatccgaccaaatatttcatttgatagagaaaaacaagaatcttacactttctat  2756

V.1:  2772  gtaaaggctgaggatggtggtagagtatcacgttcttcaagtgccaaagtaaccataaat  2831
            ||||||||||||||||||||||||||||||||||||||||||||||||||||||||||||
V.7:  2757  gtaaaggctgaggatggtggtagagtatcacgttcttcaagtgccaaagtaaccataaat  2816
```

TABLE LIII(f)-continued

Nucleotide sequence alignment of 109P1D4 v.1 (SEQ ID NO: 268) and 109P1D4 v.7 (SEQ ID NO: 269)
Score = 5664 bits (2946), Expect = 0.0 Identities = 3000/3027 (99%) Strand = Plus / Plus

```
V.1:   2832  gtggttgatgtcaatgacaacaaaccagttttcattgtccctccttccaactgttcttat  2891
             ||||||||||||||||||||||||||||||||||||||||||||||| ||||| ||||||
V.7:   2817  gtggttgatgtcaatgacaacaaaccagttttcattgtccctcctta caactattcttat  2876

V.1:   2892  gaattggttctaccgtccactaatccaggcacagtggtctttcaggtaattgctgttgac  2951
             ||||||||||||||||||||||||||||||||||||||||||||||||||||||||||||
V.7:   2877  gaattggttctaccgtccactaatccaggcacagtggtctttcaggtaattgctgttgac  2936

V.1:   2952  aatgacactggcatgaatgcagaggttcgttacagcattgtaggaggaaacacaagagat  3011
             ||||||||||||||||||||||||||||||||||||||||||||||||||||||||||||
V.7:   2937  aatgacactggcatgaatgcagaggttcgttacagcattgtaggaggaaacacaagagat  2996

V.1:   3012  ctgtttgcaatcgaccaagaaacaggcaacataacattgatggagaaatgtgatgttaca  3071
             ||||||||||||||||||||||||||||||||||||||||||||||||||||||||||||
V.7:   2997  ctgtttgcaatcgaccaagaaacaggcaacataacattgatggagaaatgtgatgttaca  3056

V.1:   3072  gaccttggtttacacagagtgttggtcaaagctaatgacttaggacagcctgattctctc  3131
             ||||||||||||||||||||||||||||||||||||||||||||||||||||||||||||
V.7:   3057  gaccttggtttacacagagtgttggtcaaagctaatgacttaggacagcctgattctctc  3116

V.1:   3132  ttcagtgttgtaattgtcaatctgttcgtgaatgagtcggtgaccaatgctacactgatt  3191
             ||||||||||||||||||||||||||||||||||||||| ||||||||||||||||||||
V.7:   3117  ttcagtgttgtaattgtcaatctgttcgtgaatgagtcagtgaccaatgctacactgatt  3176

V.1:   3192  aatgaactggtgcgcaaaagcactgaagcaccagtgaccccaaatactgagatagctgat  3251
             |||||||||||||||||||||||| |||||||||||||||||||||||||||||||||||
V.7:   3177  aatgaactggtgcgcaaaagcattgaagcaccagtgaccccaaatactgagatagctgat  3236

V.1:   3252  gtatcctcaccaactagtgactatgtcaagatcctggttgcagctgttgctggcaccata  3311
             ||||||||||||||||||||||||||||||||||||||||||||||||||||||||||||
V.7:   3237  gtatcctcaccaactagtgactatgtcaagatcctggttgcagctgttgctggcaccata  3296

V.1:   3312  actgtcgttgtagttattttcatcactgctgtagtaagatgtcgccaggcaccacacctt  3371
             |||||||||||||||||||||||||||||||||||||||||||||||||||||||||||||
V.7:   3297  actgtcgttgtagttattttcatcactgctgtagtaagatgtcgccaggcaccacacctt  3356

V.1:   3372  aaggctgctcagaaaaacaagcagaattctgaatgggctaccccaaacccagaaaacagg  3431
             ||||||||||||||||||| ||||||||||||||||||||||||||||||||||||||||
V.7:   3357  aaggctgctcagaaaaacatgcagaattctgaatgggctaccccaaacccagaaaacagg  3416

V.1:   3432  cagatgataatgatgaagaaaaagaaaaagaagaagaagcattcccctaagaacttgctg  3491
             ||||||||||||||||||||||||||||||||||||||||||||||||||||||| ||||
V.7:   3417  cagatgataatgatgaagaaaaagaaaaagaagaagaagcattcccctaagaacctgctg  3476

V.1:   3492  cttaattttgtcactattgaagaaactaaggcagatgatgttgacagtgatggaaacaga  3551
             ||||| |||||||||||||||||||||||||||||||||||||||||||||||||||||
V.7:   3477  cttaatgttgtcactattgaagaaactaaggcagatgatgttgacagtgatggaaacaga  3536

V.1:   3552  gtcacactagaccttcctattgatctagaagagcaaacaatgggaaagtacaattgggta  3611
             ||||||||||||||||||||||||||||||||||||||||||||||||||||||||||||
V.7:   3537  gtcacactagaccttcctattgatctagaagagcaaacaatgggaaagtacaattgggta  3596

V.1:   3612  actacacctactactttcaagcccgacagccctgatttggcccgacactacaaatctgcc  3671
             ||||||||||||||||||||||| ||||||||||||||||||||||||||||||||||||
V.7:   3597  actacacctactactttcaagcctgacagccctgatttggcccgacactacaaatctgcc  3656

V.1:   3672  tctccacagcctgccttccaaattcagcctgaaactcccctgaattcgaagcaccacatc  3731
             ||||||||||||||||||||||||||||||||||||||||||||||| ||||||||||||
V.7:   3657  tctccacagcctgccttccaaattcagcctgaaactcccctgaatttgaagcaccacatc  3716

V.1:   3732  atccaagaactgcctctcgataacacctttgtggcctgtgactctatctccaagtgttcc  3791
             |||||||||||||||||||||||||||||||||||||||||||||||||||| |||||||
V.7:   3717  atccaagaactgcctctcgataacacctttgtggcctgtgactctatctccaattgttcc  3776

V.1:   3792  tcaagcagttcagatccctacagcgtttctgactgtggctatccagtgacgaccttcgag  3851
             ||||||||||||||||||||||||||||||||||||||||||||||||||||| ||||||
V.7:   3777  tcaagcagttcagatccctacagcgtttctgactgtggctatccagtgacaaccttcgag  3836

V.1:   3852  gtacctgtgtccgtacacaccagaccg                                    3878
             |||||||||||||||||||||||||||
V.7:   3837  gtacctgtgtccgtacacaccagaccg                                    3863
```

TABLE LIII(f)-continued

Nucleotide sequence alignment of 109P1D4 v.1 (SEQ ID NO: 268) and 109P1D4 v.7 (SEQ ID NO: 269)
Score = 5664 bits (2946), Expect = 0.0 Identities = 3000/3027 (99%) Strand = Plus / Plus Score = 1567 bits (815), Except = 0.0 Identities = 829/836 (99%) Strands = Plus/Plus

```
V.1:    3 ggtggtccagtacctccaaagatatggaatacactcctgaaatatcctgaaaactttttt   62
          |||||||||||||||||||||||||||||||||||||||||||||||||||| ||||||||
V.7:    1 ggtggtccagtacctccaaagatatggaatacactcctgaaatatcctgaaacctttttt   60

V.1:   63 ttttcagaatcctttaataagcagttatgtcaatctgaaagttgcttacttgtactttat  122
          ||||||||||||||||||||||||||||||||||||||||||||||||||||||||||||
V.7:   61 ttttcagaatcctttaataagcagttatgtcaatctgaaagttgcttacttgtactttat  120

V.1:  123 attaatagctattcttgttttcttatccaaagaaaaatcctctaatccccttttcacat  182
          ||||||||||||||||||||||||||||||||||||||||||||||||||||||||||||
V.7:  121 attaatagctattcttgttttcttatccaaagaaaaatcctctaatccccttttcacat  180

V.1:  183 gatagttgttaccatgtttaggcattagtcacatcaacccctctcctctcccaaacttct  242
          ||||||||||||||||||||||||| ||||||||||||||||||||||||||||||||||
V.7:  181 gatagttgttaccatgtttaggcgttagtcacatcaacccctctcctctcccaaacttct  240

V.1:  243 cttcttcaaatcaaactttattagtccctcctttataatgattccttgcctcgttttatc  302
          |||||||||||||||||||||||||||||||||||||||||||||||||||||| |||||
V.7:  241 cttcttcaaatcaaactttattagtccctcctttataatgattccttgcctccttttatc  300

V.1:  303 cagatcaattttttttcactttgatgcccagagctgaagaaatggactactgtataaatt  362
          |||||||||||||||||||||||||||||||||||||||||||||||||| |||||||||
V.7:  301 cagatcaattttttttcactttgatgcccagagctgaagaaatggactattgtataaatt  360

V.1:  363 attcattgccaagagaataattgcattttaaacccatattataacaaagaataatgatta  422
          |||||||||||||||||||||||||||||||||||||| |||||||||||||||||||||
V.7:  361 attcattgccaagagaataattgcattttaaacccatgttataacaaagaataatgatta  420

V.1:  423 tattttgtgatttgtaacaaatacccttttattttcccttaactattgaattaaatatttt  482
          ||||||||||||||||||||||||||||||||||||||||||||||||||||||||||||
V.7:  421 tattttgtgatttgtaacaaatacccttttattttcccttaactattgaattaaatatttt  482

V.1:  482 aattatttgtattctctttaactatcttggtatattaaagtattatcttttatatattta  542
          ||||||||||||||||||||||||||||||||||||||||||||||||||||||||||||
V.7:  481 aattatttgtattctctttaactatcttggtatattaaagtattatcttttatatattta  540

V.1:  543 tcaatggtggacacttttataggtactctgtgtcattttgatactgtaggtatcttatt  602
          ||||||||||||||||||||||||||||||||||||||||||||||||||||||||||||
V.7:  541 tcaatggtggacacttttataggtactctgtgtcattttgatactgtaggtatcttatt  600

V.1:  603 tcatttatctttattcttaatgtacgaattcataatatttgattcagaacaaatttatca  662
          |||||||||||||||||||||||||||||||||||||||||||||||||| |||||||||
V.7:  601 tcatttatctttattcttaatgtacgaattcataatatttgattcagaacagatttatca  660

V.1:  663 ctaattaacagagtgtcaattatgctaacatctcatttactgattttaatttaaaacagt  722
          ||||||||||||||||||||||||||||||||||||||||||||||||||||||||||||
V.7:  661 ctaattaacagagtgtcaattatgctaacatctcatttactgattttaatttaaaacagt  720

V.1:  723 ttttgttaacatgcatgtttaggggttggcttcttaataatttcttcttcctcttctctct  782
          ||||||||||||||||||||||||||||||||||||||||||||||||||||||||||||
V.7:  721 ttttgttaacatgcatgtttaggggttggcttcttaataatttcttcttcctcttctctct  780

V.1:  783 ctcctcttcttttggtcagtgttgtgcgggttaatacaacaaactgtaacaagtgt  838
          ||||||||||||||||||||||||||||||||||||||||||||||||| ||||||
V.7:  781 ctcctcttcttttggtcagtgttgtgcgggttaatacaacaaactgtcacaagtgt  836
```

TABLE LIV(f)

Peptide sequences of protein coded by 109P1D4 v.7 (SEQ ID NO: 270)

| | | | | | |
|---|---|---|---|---|---|
| MFRVGFLIIS | SSSSLSPLLL | VSVVRVNTTN | CHKCLLSGTY | IFAVLLVCVV | FHSGAQEKNY | 60 |
| TIREEIPENV | LIGNLLKDLN | LSLIPNKSLT | TTMQFKLVYK | TGDVPLIRIE | EDTGEIFTTG | 120 |
| ARIDREKLCA | GIPRDEHCFY | EVEVAILPDE | IFRLVKIRFL | IEDINDNAPL | FPATVINISI | 180 |
| PENSAINSKY | TLPAAVDPDV | GINGVQNYEL | IKSQNIFGLD | VIETPEGDKM | PQLIVQKELD | 240 |
| REEKDTYVMK | VKVEDGGFPQ | RSSTAILQVS | VTDTNDNHPV | FKETEIEVSI | PENAPVGTSV | 300 |

TABLE LIV(f)-continued

Peptide sequences of protein coded by 109P1D4 v.7 (SEQ ID NO: 270)

```
TQLHATDADI GENAKIHFSF SNLVSNIARR LFHLNATTGL ITIKEPLDRE ETPNHKLLVL    360

ASDGGLMPAR AMVLVNVTDV NDNVPSIDIR YIVNPVNDTV VLSENIPLNT KIALITVTDK    420

DADHNGRVTC FTDHEIPFRL RPVFSNQFLL ENAAYLDYES TKEYAIKLLA ADAGKPPLNQ    480

SAMLFIKVKD ENDNAPVFTQ SFVTVSIPEN NSPGIQLMKV SATDADSGPN AEINYLLGPD    540

APPEFSLDRR TGMLTVVKKL DREKEDKYLF TILAKDNGVP PLTSNVTVFV SIIDQNDNSP    600

VFTHNEYKFY VPENLPRHGT VGLITVTDPD YGDNSAVTLS ILDENDDFTI DSQTGVIRPN    660

ISFDREKQES YTFYVKAEDG GRVSRSSSAK VTINVVDVND NKPVFIVPPY NYSYELVLPS    720

TNPGTVVFQV IAVDNDTGMN AEVRYSIVGG NTRDLFAIDQ ETGNITLMEK CDVTDLGLHR    780

VLVKANDLGQ PDSLFSVVIV NLFVNESVTN ATLINELVRK SIEAPVTPNT EIADVSSPTS    840

DYVKILVAAV AGTITVVVVI FITAVVRCRQ APHLKAAQKN MQNSEWATPN PENRQMIMMK    900

KKKKKKHSP  KNLLLNVVTI EETKADDVDS DGNRVTLDLP IDLEEQTMGK YNWVTTPTTF    960

KPDSPDLARH YKSASPQPAF QIQPETPLNL KHHIIQELPL DNTFVACDSI SNCSSSSSDP   1020

YSVSDCGYPV TTFEVPVSVH TRPTDSRT                                     1048
```

TABLE LV(f)

Amino acid sequence alignment of 109P1D4 v.1 (SEQ ID NO: 271) and 109P1D4 v.7 (SEQ ID NO: 272) Score = 1961 bits (5081), Expect = 0.0 Identities = 992/1009 (98%), Positives = 995/1009 (98%)

```
V.1   3 LLSGTYIFAVLLACVVFHSGAQEKNYTIREEMPENVLIGDLLKDLNLSLIPNKSLTTAMQ  62
        LLSGTYIFAVLL CVVFHSGAQEKNYTIREE+PENVLIG+LLKDLNLSLIPNKSLTT MQ
V.7  35 LLSGTYIFAVLLVCVVFHSGAQEKNYTIREEIPENVLIGNLLKDLNLSLIPNKSLTTTMQ  94

V.1  63 FKLVYKTGDVPLIRIEEDTGEIFTTGARIDREKLCAGIPRDEHCFYEVEVAILPDEIFRL 122
        FKLVYKTGDVPLIRIEEDTGEIFTTGARIDREKLCAGIPRDEHCFYEVEVAILPDEIFRL
V.7  95 FKLVYKTGDVPLIRIEEDTGEIFTTGARIDREKLCAGIPRDEHCFYEVEVAILPDEIFRL 154

V.1 123 VKIRFLIEDINDNAPLFPATVINISIPENSAINSKYTLPAAVDPDVGINGVQNYELIKSQ 182
        VKIRFLIEDINDNAPLFPATVINISIPENSAINSKYTLPAAVDPDVGINGVQNYELIKSQ
V.7 155 VKIRFLIEDINDNAPLFPATVINISIPENSAINSKYTLPAAVDPDVGINGVQNYELIKSQ 214

V.1 183 NIFGLDVIETPEGDKMPQLIVQKELDREEKDTYVMKVKVEDGGFPQRSSTAILQVSVTDT 242
        NIFGLDVIETPEGDKMPQLIVQKELDREEKDTYVMKVKVEDGGFPQRSSTAILQVSVTDT
V.7 215 NIFGLDVIETPEGDKMPQLIVQKELDREEKDTYVMKVKVEDGGFPQRSSTAILQVSVTDT 274

V.1 243 NDNHPVFKETEIEVSIPENAPVGTSVTQLHATDADIGENAKIHFSFSNLVSNIARRLFHL 302
        NDNHPVFKETEIEVSIPENAPVGTSVTQLHATDADIGENAKIHFSFSNLVSNIARRLFHL
V.7 275 NDNHPVFKETEIEVSIPENAPVGTSVTQLHATDADIGENAKIHFSFSNLVSNIARRLFHL 334

V.1 303 NATTGLITIKEPLDREETPNHKLLVLASDGGLMPARAMVLVNVTDVNDNVPSIDIRYIVN 362
        NATTGLITIKEPLDREETPNHKLLVLASDGGLMPARAMVLVNVTDVNDNVPSIDIRYIVN
V.7 335 NATTGLITIKEPLDREETPNHKLLVLASDGGLMPARANVLVNVTDVNDNVPSIDIRYIVN 394

V.1 363 PVNDTVVLSENIPLNTKIALITVTDKDADHNGRVTCFTDHEIPFRLRPVFSNQFLLETAA 422
        PVNDTVVLSENIPLNTKIALITVTDKDADHNGRVTCFTDHEIPFRLRPVFSNQFLLE AA
V.7 395 PVNDTVVLSENIPLNTKIALITVTDKDADMNGRVTCFTDHEIPFRLRPVFSNQFLLENAA 454

V.1 423 YLDYESTKEYAIKLLAADAGKPPLNQSAMLFIKVKDENDNAPVFTQSFVTVSIPENNSPG 482
        YLDYESTKEYAIKLLAADAGKPPLNQSAMLFIKVKDENDNAPVFTQSFVTVSIPENNSPG
V.7 455 YLDYESTKEYAIKLLAADAGKPPLNQSAMLFIKVKDENDNAPVFTQSFVTVSIPENNSPG 514

V.1 483 IQLTKVSANDADSGPNAKINYLLGPDAPPEFSLDCRTGMLTVVKKLDREKEDKYLFTILA 542
        IQL KVSA DADSGPNA+INYLLGPDAPPEFSLD RTGMLTVVKKLDREKEDKYLFTILA
V.7 515 IQLMKVSATDADSGPNAEINYLLGPDAPPEFSLDRRTGMLTVVKKLDREKEDKYLFTILA 574

V.1 543 KDNGVPPLTSNVTVFVSIIDQNDNSPVFTHNEYNFYVPENLPRHGTVGLITVTDPDYGDN 602
        KDNGVPPLTSNVTVFVSIIDQNDNSPVFTHNEY FYVPENLPRHGTVGLITVTDPDYGDN
V.7 575 KDNGVPPLTSNVTVFVSIIDQNDNSPVFTHNEYKFYVPENLPRHGTVGLITVTDPDYGDN 634

V.1 603 SAVTLSILDENDDFTIDSQTGVIRPNISFDREKQESYTFYVKAEDGGRVSRSSSAKVTIN 662
        SAVTLSILDENDDFTIDSQTGVIRPNISFDREKQESYTFYVKAEDGGRVSRSSSAKVTIN
V.7 635 SAVTLSILDENDDFTIDSQTGVIRPNISFDREKQESYTFYVKAEDGGRVSRSSSAKVTIN 694
```

TABLE LV(f)-continued

Amino acid sequence alignment of 109P1D4 v.1 (SEQ ID NO: 271) and 109P1D4 v.7 (SEQ ID NO: 272) Score = 1961 bits (5081), Expect = 0.0Identities = 992/1009 (98%), Positives = 995/1009 (98%)

```
V.1 663 VVDVNDNKPVFIVPPSNCSYELVLPSTNPGTVVFQVIAVDNDTGMNAEVRYSIVGGNTRD 722
        VVDVNDNKPVFIVPP N SYELVLPSTNPGTVVFQVIAVDNDTGMNAEVRYSIVGGNTRD
V.7 695 VVDVNDNKPVFIVPPYNYSYELVLPSTNPGTVVFQVIAVDNDTGMNAEVRYSIVGGNTRD 754

V.1 723 LFAIDQETGNITLMEKCDVTDLGLHRVLVKANDLGQPDSLFSVVIVNLFVNESVTNATLI 782
        LFAIDQETGNITLMEKCDVTDLGLMRVLVKANDLGQPDSLFSVVIVNLFVNESVTNATLI
V.7 755 LFAIDQETGNITLMEKCDVTDLGLHRVLVKANDLGQPDSLFSVVIVNLFVNESVTNATLI 814

V.1 783 NELVRKSTEAPVTPNTEIADVSSPTSDYVKILVAAVAGTITVVVVIFITAVVRCRQAPHL 842
        NELVRKS EAPVTPNTEIADVSSPTSDYVKILVAAVAGTITVVVVIFITAVVRCRQAPHL
V.7 815 NELVRKSIEAPVTPNTEIADVSSPTSDYVKILVAAVAGTITVVVVIFITAVVRCRQAPHL 874

V.1 843 KAAQKNKQNSEWATPNPENRQMIMMKKKKKKKKHSPKNLLLNFVTIEETKADDVDSDGNR 902
        KAAQKN QNSEWATPNPENRQMIMMKKKKKKKKHSPKNLLLN VTIEETKADDVDSDGNR
V.7 875 KAAQKNQNSEWATPNPENRQMIMMKKKKKKKKHSPKNLLLNVVTI EETKADDVDSDGNR 934

V.1 903 VTLDLPIDLEEQTMGKYNWVTTPTTFKPDSPDLARHYKSASPQPAFQIQPETPLNSKHMI 962
        VTLDLPIDLEEQTMGKYNWVTTPTTFKPDSPDLARHYKSASPQPAFQIQPETPLN KHHI
V.7 935 VTLDLPIDLEEQTMGKYNWVTTPTTFKPDSPDLARHYKSASPQPAFQIQPETPLNLKHHI 994

V.1 963 IQELPLDNTFVACDSISKCSSSSSDPYSVSDCGYPVTTFEVPVSVHTRP 1011
        IQELPLDNTFVACDSIS CSSSSSDPYSVSDCGYPVTTFEVPVSVHTRP
V.7 995 IQELPLDNTFVACDSISNCSSSSSDPYSVSDCGYPVTTFEVPVSVHTRP 1043
```

TABLE LII(g)

Nucleotide sequence of transcript variant 109P1D4 v.8
(SEQ ID NO: 273)

```
ggtggtccag tacctccaaa gatatggaat acactcctga aatatcctga aacctttttt    60
ttttcagaat cctttaataa gcagttatgt caatctgaaa gttgcttact tgtactttat   120
attaatagct attcttgttt ttcttatcca aagaaaaatc ctctaatccc cttttcacat   180
gatagttgtt accatgttta ggcgttagtc acatcaaccc ctctcctctc ccaaacttct   240
cttcttcaaa tcaaacttta ttagtccctc ctttataatg attccttgcc tcctttatc    300
cagatcaatt ttttttcact tgatgccca gagctgaaga aatggactat tgtataaatt    360
attcattgcc aagagaataa ttgcatttta aacccatgtt ataacaaaga ataatgatta   420
tattttgtga tttgtaacaa ataccctta ttttcccta actattgaat taaatatttt     480
aattatttgt attctcttta actatcttgg tatattaaag tattatcttt tatatattta   540
tcaatggtgg acactttat aggtactctg tgtcatttt gatactgtag gtatcttatt     600
tcatttatct ttattcttaa tgtacgaatt cataatattt gattcagaac agatttatca   660
ctaattaaca gagtgtcaat tatgctaaca tctcatttac tgattttaat ttaaaacagt   720
ttttgttaac atgcatgttt agggttggct tcttaataat ttcttcttcc tcttctctct   780
ctcctcttct tttggtcagt gttgtgcggg ttaatacaac aaactgtcac aagtgtttgt   840
tgtccgggac gtcatttc gcggtcctgc tagtatgcgt ggtgttccac tctggcgccc     900
aggagaaaaa ctacaccatc cgagaagaaa ttccagaaaa cgtcctgata ggcaacttgt   960
tgaaagacct taacttgtcg ctgattccaa acaagtcctt gacaactact atgcagttca  1020
agctagtgta caagaccgga gatgtgccac tgattcgaat tgaagaggat actggtgaga  1080
tcttcactac cggcgctcgc attgatcgtg agaaattatg tgctggtatc ccaagggatg  1140
agcattgctt ttatgaagtg gaggttgcca ttttgccgga tgaaatattt agactggtta  1200
agatacgttt tctgatagaa gatataaatg ataatgcacc attgttccca gcaacagtta  1260
tcaacatatc aattccagag aactcggcta taaactctaa atatactctc ccagcggctg  1320
```

TABLE LII(g)-continued

Nucleotide sequence of transcript variant 109P1D4 v.8
(SEQ ID NO: 273)

```
ttgatcctga cgtaggcata aacggagttc aaaactacga actaattaag agtcaaaaca  1380
tttttggcct cgatgtcatc gaaacaccag aaggagacaa gatgccacaa ctgattgttc  1440
aaaaggagtt agatagggaa gagaaggata cctatgtgat gaaagtaaag gttgaagatg  1500
gtggctttcc tcaaagatcc agtactgcta ttttgcaagt aagtgttact gatacaaatg  1560
acaaccaccc agtctttaag gagacagaga ttgaagtcag tataccagaa aatgctcctg  1620
taggcacttc agtgacacag ctccatgcca cagatgctga cataggtgaa aatgccaaga  1680
tccacttctc tttcagcaat ctagtctcca acattgccag gagattattt caccctcaatg 1740
ccaccactgg acttatcaca atcaaagaac cactggatag ggaagaaaca ccaaaccaca  1800
agttactggt tttggcaagt gatggtggat tgatgccagc aagagcaatg gtgctggtaa  1860
atgttacaga tgtcaatgat aatgtcccat ccattgacat aagatacatc gtcaatcctg  1920
tcaatgacac agttgttctt tcagaaaata ttccactcaa caccaaaatt gctctcataa  1980
ctgtgacgga taaggatgcg gaccataatg gcagggtgac atgcttcaca gatcatgaaa  2040
ttcctttcag attaaggcca gtattcagta atcagttcct cctggagaat gcagcatatc  2100
ttgactatga gtccacaaaa gaatatgcca ttaaattact ggctgcagat gctggcaaac  2160
ctcctttgaa tcagtcagca atgctcttca tcaaagtgaa agatgaaaat gacaatgctc  2220
cagttttcac ccagtctttc gtaactgttt ctattcctga gaataactct cctggcatcc  2280
agttgatgaa agtaagtgca acggatgcag acagtgggcc taatgctgag atcaattacc  2340
tgctaggccc tgatgctcca cctgaattca gcctggatcg tcgtacaggc atgctgactg  2400
tagtgaagaa actagataga gaaaaagagg ataaatattt attcacaatt ctggcaaaag  2460
ataatggggt accacccta accagcaatg tcacagtctt tgtaagcatt attgatcaga   2520
atgacaatag cccagttttc actcacaatg aatacaaatt ctatgtccca gaaaaccttc  2580
caaggcatgg tacagtagga ctaatcactg taactgatcc tgattatgga gacaattctg  2640
cagttacgct ctccatttta gatgagaatg atgcttcac cattgattca caaactggtg   2700
tcatccgacc aaatatttca tttgatagag aaaaacaaga atcttacact ttctatgtaa  2760
aggctgagga tggtggtaga gtatcacgtt cttcaagtgc caaagtaacc ataaatgtgg  2820
ttgatgtcaa tgacaacaaa ccagtttttca ttgtccctcc ttacaactat tcttatgaat  2880
tggttctacc gtccactaat ccaggcacag tggtctttca ggtaattgct gttgacaatg  2940
acactggcat gaatgcagag gttcgttaca gcattgtagg aggaaacaca agagatctgt  3000
ttgcaatcga ccaagaaaca ggcaacataa cattgatgga gaaatgtgat gttacagacc  3060
ttggtttaca cagagtgttg gtcaaagcta atgacttagg acagcctgat tctctcttca  3120
gtgttgtaat tgtcaatctg ttcgtgaatg agtcagtgac caatgctaca ctgattaatg  3180
aactggtgcg caaaagcatt gaagcaccag tgaccccaaa tactgagata gctgatgtat  3240
cctcaccaac tagtgactat gtcaagatcc tggttgcagc tgttgctggc accataactg  3300
tcgttgtagt tattttcatc actgctgtag taagatgtcg ccaggcacca caccttaagg  3360
ctgctcagaa aaacatgcag aattctgaat gggctacccc aaacccagaa acaggcagaa  3420
tgataatgat gaagaaaaag aaaagaaga agaagcattc ccctaagaac ctgctgctta   3480
atgttgtcac tattgaagaa actaaggcag atgatgttga cagtgatgga aacagagtca   3540
cactagacct tcctattgat ctagaagagc aaacaatggg aaagtacaat tgggtaacta  3600
```

TABLE LII(g)-continued

Nucleotide sequence of transcript variant 109P1D4 v.8
(SEQ ID NO: 273)

| | | | | |
|---|---|---|---|---|
| cacctactac | tttcaagcct | gacagcctg | atttggcccg | acactacaaa | tctgcctctc | 3660 |
| cacagcctgc | cttccaaatt | cagcctgaaa | ctccctgaa | tttgaagcac | acatcatcc | 3720 |
| aagaactgcc | tctcgataac | acctttgtgg | cctgtgactc | tatctccaat | tgttcctcaa | 3780 |
| gcagttcaga | tccctacagc | gtttctgact | gtggctatcc | agtgacaacc | ttcgaggtac | 3840 |
| ctgtgtccgt | acacaccaga | ccgtcccagc | ggcgtgtcac | atttcacctg | ccagaaggct | 3900 |
| ctcaggaaag | cagcagtgat | ggtggactgg | gagaccatga | tgcaggcagc | cttaccagca | 3960 |
| catcccatgg | cctgcccctt | ggctatcctc | aggaggagta | ctttgatcgt | gctacaccca | 4020 |
| gcaatcgcac | tgaaggggat | ggcaactccg | atcctgaatc | tactttcata | cctggactaa | 4080 |
| agaaagaaat | aactgttcaa | ccaactgtgg | aagaggcctc | tgacaactgc | actcaagaat | 4140 |
| gtctcatcta | tggccattct | gatgcctgct | ggatgccggc | atctctggat | cattccagct | 4200 |
| cttcacaagc | acaggcctct | gctctatgcc | acagcccacc | actgtcacag | gcctctactc | 4260 |
| agcaccacag | cccaccagtg | acacagacca | ttgttctctg | ccacagccct | ccagtgacac | 4320 |
| agaccatcgc | attgtgccac | agcccaccac | cgatacaggt | gtctgctctc | caccacagtc | 4380 |
| ctcctctagt | gcagggtact | gcacttcacc | acagcccacc | atcagcacag | gcctcagccc | 4440 |
| tctgctacag | ccctccttta | gcacaggctg | ctgcaatcag | ccacagctct | tctctgccac | 4500 |
| aggttattgc | cctccatcgt | agtcaggccc | aatcatcagt | cagtttgcag | caaggttggg | 4560 |
| tgcaaggtgc | taatggacta | tgctctgttg | atcagggagt | gcaaggtagt | gcaacatctc | 4620 |
| agttttacac | catgtctgaa | agacttcatc | ccagtgatga | ttcaattaaa | gtcattcctt | 4680 |
| tgacaaccct | cgctccacgc | caacaggcca | gaccgtccag | aggtgattcc | cccattatgg | 4740 |
| aaacacatcc | cttgtaaagc | taaaatagtt | acttcaaatt | ttcagaaaag | atgtatatag | 4800 |
| tcaaaattta | agatacaatt | ccaatgagta | ttctgattat | cagatttgta | aataactatg | 4860 |
| taaatagaaa | cagataccag | aataaatcta | cagctagacc | cttagtcaat | agttaaccaa | 4920 |
| aaaattgcaa | tttgtttaat | tcagaatgtg | tatttaaaaa | gaaaggaat | ttaacaattt | 4980 |
| gcatcccctt | gtacagtaag | gcttatcatg | acagagcgta | ctatttctga | tgtacagtat | 5040 |
| tttttgttgt | tttatcatc | atgtgcaata | ttactgattt | gtttccatgc | tgattgtgtg | 5100 |
| gaaccagtat | gtagcaaatg | gaaagcctag | aaatatctta | ttttctaagt | ttacctttag | 5160 |
| tttacctaaa | cttttgttca | gataatgtta | aaaggtatac | gtactctagc | cttttttggg | 5220 |
| gctttcttt | tgattttgt | ttgtggtttt | cagttttttt | gttgttgtta | gtgagtctcc | 5280 |
| cttcaaaata | cacagtaggt | agtgtaaata | ctgcttgttt | gtgtctctct | gctgtcatgt | 5340 |
| tttctacctt | attccaatac | tatattgttg | ataaaatttg | tatatacatt | ttcaataaag | 5400 |
| aatatgtata | aactgtacag | atctagatct | acaacctatt | tctctactct | ttagtagagt | 5460 |
| tcgagacaca | gaagtgcaat | aactgcccta | attaagcaac | tatttgttaa | aaagggcccc | 5520 |
| tttttactt | aatagtttag | tgtaaagtac | atcagaaata | aaactgtatc | tgacattta | 5580 |
| agcctgtagt | ccattattac | ttgggtcttt | acttctggga | atttgtatgt | aacagcctag | 5640 |
| aaaattaaaa | ggaggtggat | gcatccaaag | cacgagtcac | ttaaaatatc | gacggtaaac | 5700 |
| tactattttg | tagagaaact | caggaagatt | taaatgttga | tttgacagct | caataggctg | 5760 |
| ttaccaaagg | gtgttcagta | aaaataacaa | atacatgtaa | ctgtagataa | aaccacatac | 5820 |
| taaatctata | agactaaggg | attttgtta | ttctagctca | acttactgaa | gaaaccact | 5880 |
| aataacaaca | agaatatcag | gaaggaactt | ttcaagaaat | gtaattataa | atctacatca | 5940 |

TABLE LII(g)-continued

Nucleotide sequence of transcript variant 109P1D4 v.8
(SEQ ID NO: 273)

```
aacagaattt taaggaaaaa tgcagaggga gaaataaggc acatgactgc ttcttgcagt      6000
caagaagaaa taccaataac acacacagaa caaaaaccat caaaatctca tatatgaaat      6060
aaaatatatt cttctaagca aagaaacagt actattcata gaaaacatta gttttctcct      6120
gttgtctgtt atttccttct tttatcctct taactggcca ttatcttgta tgtgcacatt      6180
ttataaatgt acagaaacat caccaacttg attttcttcc atagcaaaac tgagaaaata      6240
ccttgtttca gtataacact aaaccaagag acaattgatg tttaatgggg gcggttgggg      6300 ttgggggggga gtcaatatct cctattgatt aacttagaca tagattttgt aatgtataac     6360
ttgatattta atttatgatt aaactgtaat tttgtaacat aaactgtggt aattgcataa      6420
tttcattggt gaggatttcc tttgaatatt gagaaagttt cttttcatgt gcccagcagg      6480
ttaagtagcg ttttcagaat atacattatt cccatccatt gtaaagttcc ttaagtcata      6540
tttgactggg cgtgcagaat aacttcttaa ctattaacta tcagagtttg attaataaaa      6600
ttaattaatt ttttttctcc ttcgtgttgt taatgttcca agggatttgg agcatactgg      6660
ttttccaggt gcatgtgaat cccgaaggac tgatgatatt tgaatgttta ttaaattatt      6720
atcacacaaa tgtgttgata ttgtggctat tgttgatgtt gaaaattgta aacttgggga     6780
agattaagaa aagaaccaat agtgacaaaa atcagtgctt ccagtagatt ttagaacatt      6840
ctttgcctca aaaaacctgc aaagatgatg tgagattttt tcttgtgttt taattatttt      6900
cacattttct ctctgcaaac ctttagtttt ctgatgatct acacacacac atacacacac     6960
acacacacac acgtgcacac acacacattt aaaggatata aaaagaagag gttgaaagat      7020
tattaaataa cttatcaggc atctcaatgg ttactatcta tgttagtgaa aatcaaatag      7080
gactcaaagt tggatatttg ggattttttct tctgacagta taatttattg agttactagg     7140
gaggttctta aatcctcata tctggaaact tgtgaagttt tgacaccttt cctatagata      7200
taggaatgaa ccaatacgct tttattaccc tttctaactc tgattttata atcagactta      7260
gattgtgttt agaatattaa atgactgggc accctcttct tggtttttac cagagaggct      7320
ttgaatggaa gcaggctgag agtagccaaa gaggcaaggg gtattagccc agttattctc      7380
ccctatgcct tctcttccta agcgtccact aggtctggcc ttggaaatct gttacttcta      7440
cggcttcaga tctgatgata tcttttttcat cacattacaa gttatttctt tgactgaata      7500
gacagtggta taggttgaca cagcacacaa gtggctattg tgatgtatga tgtatgtagt     7560
cccacaactg caaaacgtct tactgaagca acaatcgaaa aatggttctg ttttaaaaag     7620
gattttgttt gatttgaaat taaaacttca aactgaatga cttatatgag aataatatgt     7680
tcaatcaaag tagttattct attttgtgtc catattccat tagattgtga ttattaattt      7740
tctagctatg gtattactat atcacacttg tgagtatgta ttcaaatact aagtatctta     7800
tatgctacgt gcatacacat tcttttctta aactttacct gtgttttaac taatattgtg      7860
tcagtgtatt aaaaattagc ttttacatat gatatctaca atgtaataaa tttagagagt      7920
aattttgtgt attcttattt acttaacatt ttactttaa ttatgtaaat ttggttagaa      7980
aataataata aatggttagt gctattgtgt aatggtagca gttacaaaga gcctctgcct     8040
tcccaaacta atatttatca cacatggtca ttaaatggga aaaaaataga ctaaacaaat      8100
cacaaattgt tcagttctta aaatgtaatt atgtcacaca cacaaaaaaa tccttttcaa      8160
tcctgagaaa attaaaggtg ttttactcac atggatattt caacattagt ttttttttgtt     8220
```

TABLE LII(g)-continued

Nucleotide sequence of transcript variant 109P1D4 v.8
(SEQ ID NO: 273)

```
tgtttcttttt tcatggtatt actgaaggtg tgtatactcc ctaatacaca tttatgaaaa   8280
tctacttgtt tagactttta tttatactct tctgatttat attttttatt ataattatta   8340
tttcttatct tcttttatat tttttggaaa ccaaatttat agttagttta ggtaaacttt   8400
ttattatgac cattagaaac tattttgaat gtttccaact ggctcaattg gctgggaaaa   8460
catgggaaca agagaagctg aaatatattt ctgcaagaac ctttctatat tatgtgccaa   8520
ttaccacacc agatcaattt tatgcagagg ccttaaaata ttctttcaca gtagctttct   8580
tacactaacc gtcatgtgct tttagtaaat atgatttta aaagcagttc aagttgacaa     8640
cagcagaaac agtaacaaaa aaatctgctc agaaaaatgt atgtgcacaa ataaaaaaaa   8700
ttaatggcaa ttgtttagtg actgtaagtg atactttta aagagtaaac tgtgtgaaat    8760
ttatactatc cctgcttaaa atattaagat ttttatgaaa tatgtattta tgtttgtatt   8820
gtgggaagat tcctcctctg tgatatcata cagcatctga aagtgaacag tatcccaaag   8880
cagttccaag catgctttgg aagtaagaag gttgactatt gtatggccaa ggatggcagt   8940
atgtaatcca gaagcaaact tgtattaatt gttctatttc aggttctgta ttgcatgttt   9000
tcttattaat atatattaat aaaagttatg agaaat                              9036
```

TABLE LIII(g)

Nucleotide sequence alignment of 109P1D4 v.1 (SEQ ID NO: 274) and 109P1D4 v.8 (SEQ ID NO: 275)
Score = 5664 bits (2946), Expect = 0.0 Identibes = 3000/3027 (99%) Strand = Plus/Plus

```
V.1:    852  ttgttgtccgggacgtacattttcgcggtcctgctagcatgcgtggtgttccactctggc   911
             |||||||||||||||||||||||||||||||||||||| |||||||||||||||||||||
V.7:    837  ttgttgtccgggacgtacattttcgcggtcctgctagtatgcgtggtgttccactctggc   896

V.1:    912  gcccaggagaaaaactacaccatccgagaagaaatgccagaaaacgtcctgataggcgac   971
             ||||||||||||||||||||||||||||||||||||| |||||||||||||||||||| ||
V.7:    897  gcccaggagaaaaactacaccatccgagaagaaattccagaaaacgtcctgataggcaac   956

V.1:    972  ttgttgaaagaccttaacttgtcgctgattccaaacaagtccttgacaactgctatgcag  1031
             |||||||||||||||||||||||||||||||||||||||||||||||||||| |||||||
V.7:    957  ttgttgaaagaccttaacttgtcgctgattccaaacaagtccttgacaactactatgcag  1016

V.1:   1032  ttcaagctagtgtacaagaccggagatgtgccactgattcgaattgaagaggatactggt  1091
             |||||||||||||||||||||||||||||||||||||||||||||||||||| |||||||
V.7:   1017  ttcaagctagtgtacaagaccggagatgtgccactgattcgaattgaagaggatactggt  1076

V.1:   1092  gagatcttcactactggcgctcgcattgatcgtgagaaattatgtgctggtatcccaagg  1151
             ||||||||||||| ||||||||||||||||||||||||||||||||||||||||||||||
V.7:   1077  gagatcttcactaccggcgctcgcattgatcgtgagaaattatgtgctggtatcccaagg  1136

V.1:   1152  gagatcttcactactggcgctcgcattgatcgtgagaaattatgtgctggtatcccaagg  1211
             ||||||||||||| ||||||||||||||||||||||||||||||||||||||||||||||
V.7:   1137  gagatcttcactaccggcgctcgcattgatcgtgagaaattatgtgctggtatcccaagg  1196

V.1:   1212  gttaagatacgttttctgatagaagatataaatgataatgcaccattgttcccagcaaca  1271
             ||||||||||||||||||||||||||||||||||||||||||||||||||||||||||||
V.7:   1197  gttaagatacgttttctgatagaagatataaatgataatgcaccattgttcccagcaaca  1256

V.1:   1272  gttatcaacatatcaattccagagaactcggctataaactctaaatatactctcccagcg  1331
             ||||||||||||||||||||||||||||||||||||||||||||||||||||||||||||
V.7:   1257  gttatcaacatatcaattccagagaactcggctataaactctaaatatactctcccagcg  1316

V.1:   1332  gctgttgatcctgacgtaggaataaaacggagttcaaaactacgaactaattaagagtcaa  1391
             |||||||||||||||||||||| |||||||||||||||||||||||||||||||||||||
V.7:   1317  gctgttgatcctgacgtaggcataaacggagttcaaaactacgaactaattaagagtcaa  1376

V.1:   1392  aacatttttggcctcgatgtcattgaaacaccagaaggagacaagatgccacaactgatt  1451
             ||||||||||||||||||||||||||||||||||||||||||||||||||||||||||||
V.7:   1377  aacatttttggcctcgatgtcattgaaacaccagaaggagacaagatgccacaactgatt  1436
```

TABLE LIII(g)-continued

Nucleotide sequence alignment of 109P1D4 v.1 (SEQ ID NO: 274) and 109P1D4 v.8 (SEQ ID NO: 275)
Score = 5664 bits (2946), Expect = 0.0 Identities = 3000/3027 (99%) Strand = Plus/Plus

```
V.1:   1452  gttcaaaaggagttagatagggaagagaaggatacctacgtgatgaaagtaaaggttgaa  1511
             ||||||||||||||||||||||||||||||||||||| ||||||||||||||||||||||
V.7:   1437  gttcaaaaggagttagatagggaagagaaggatacctatgtgatgaaagtaaaggttgaa  1496

V.1:   1512  gatggtggctttcctcaaagatccagtactgctattttgcaagtgagtgttactgataca  1571
             |||||||||||||||||||||||||||||||||||||||||||| |||||||||||||||
V.8:   1497  gatggtggctttcctcaaagatccagtactgctattttgcaagtaagtgttactgataca  1556

V.1:   1572  aatgacaaccacccagtctttaaggagacagagattgaagtcagtataccagaaaatgct  1631
             ||||||||||||||||||||||||||||||||||||||||||||||||||||||||||||
V.8:   1557  aatgacaaccacccagtctttaaggagacagagattgaagtcagtataccagaaaatgct  1616

V.1:   1632  cctgtaggcacttcagtgacacagctccatgccacagatgctgacataggtgaaaatgcc  1691
             ||||||||||||||||||||||||||||||||||||||||||||||||||||||||||||
V.8:   1617  cctgtaggcacttcagtgacacagctccatgccacagatgctgacataggtgaaaatgcc  1676

V.1:   1692  aagatccacttctctttcagcaatctagtctccaacattgccaggagattatttcacctc  1751
             ||||||||||||||||||||||||||||||||||||||||||||||||||||||||||||
V.8:   1677  aagatccacttctctttcagcaatctagtctccaacattgccaggagattatttcacctc  1736

V.1:   1752  aatgccaccactggacttatcacaatcaaagaaccactggatagggaagaaacaccaaac  1811
             ||||||||||||||||||||||||||||||||||||||||||||||||||||||||||||
V.8:   1737  aatgccaccactggacttatcacaatcaaagaaccactggatagggaagaaacaccaaac  1796

V.1:   1812  cacaagttactggttttggcaagtgatggtggattgatgccagcaagagcaatggtgctg  1871
             ||||||||||||||||||||||||||||||||||||||||||||||||||||||||||||
V.8:   1797  cacaagttactggttttggcaagtgatggtggattgatgccagcaagagcaatggtgctg  1856

V.1:   1872  gtaaatgttacagatgtcaatgataatgtcccatccattgacataagatacatcgtcaat  1931
             ||||||||||||||||||||||||||||||||||||||||||||||||||||||||||||
V.8:   1857  gtaaatgttacagatgtcaatgataatgtcccatccattgacataagatacatcgtcaat  1916

V.1:   1932  cctgtcaatgacacagttgttctttcagaaaatattccactcaacaccaaaattgctctc  1991
             ||||||||||||||||||||||||||||||||||||||||||||||||||||||||||||
V.8:   1917  cctgtcaatgacacagttgttctttcagaaaatattccactcaacaccaaaattgctctc  1976

V.1:   1992  ataactgtgacggataaggatgcggaccataatggcagggtgacatgcttcacagatcat  2051
             ||||||||||||||||||||||||||||||||||||||||||||||||||||||||||||
V.8:   1977  ataactgtgacggataaggatgcggaccataatggcagggtgacatgcttcacagatcat  2036

V.1:   2052  gaaatcccttttcagattaaggccagtattcagtaatcagttcctcctggagactgcagca  2111
             |||||  |||||||||||||||||||||||||||||||||||||||||||||  |||||||
V.8:   2037  gaaattccttttcagattaaggccagtattcagtaatcagttcctcctggagaatgcagca  2096

V.1:   2112  tatcttgactatgagtccacaaaagaatatgccattaaattactggctgcagatgctggc  2171
             ||||||||||||||||||||||||||||||||||||||||||||||||||||||||||||
V.8:   2097  tatcttgactatgagtccacaaaagaatatgccattaaattactggctgcagatgctggc  2156

V.1:   2172  aaacctcctttgaatcagtcagcaatgctcttcatcaaagtgaaagatgaaaatgacaat  2231
             ||||||||||||||||||||||||||||||||||||||||||||||||||||||||||||
V.8:   2157  aaacctcctttgaatcagtcagcaatgctcttcatcaaagtgaaagatgaaaatgacaat  2216

V.1:   2232  gctccagttttcacccagtctttcgtaactgtttctattcctgagaataactctcctggc  2291
             ||||||||||||||||||||||||||||||||||||||||||||||||||||||||||||
V.8:   2217  gctccagttttcacccagtctttcgtaactgtttctattcctgagaataactctcctggc  2276

V.1:   2292  atccagttgacgaaagtaagtgcaatggatgcagacagtgggcctaatgctaagatcaat  2351
             |||||||| |||||||||||||||| ||||||||||||||||||||||||| ||||||||
V.8:   2277  atccagttgatgaaagtaagtgcaacggatgcagacagtgggcctaatgctgagatcaat  2336

V.1:   2352  tacctgctaggccctgatgctccacctgaattcagcctggattgtcgtacaggcatgctg  2411
             |||||||||||||||||||||||||||||||||||||||||| |||||||||||||||||
V.8:   2337  tacctgctaggccctgatgctccacctgaattcagcctggatcgtcgtacaggcatgctg  2396

V.1:   2412  actgtagtgaagaaactagatagagaaaagaggataaatatttattcacaattctggca  2471
             ||||||||||||||||||||||||||||||||||||||||||||||||||||||||||||
V.8:   2397  actgtagtgaagaaactagatagagaaaagaggataaatatttattcacaattctggca  2456

V.1:   2472  aaagataacggggtaccacccttaaccagcaatgtcacagtctttgtaagcattattgat  2531
             ||||||| ||||||||||||||||||||||||||||||||||||||||||||||||||||
V.8:   2457  aaagataatggggtaccacccttaaccagcaatgtcacagtctttgtaagcattattgat  2516
```

TABLE LIII(g)-continued

Nucleotide sequence alignment of 109P1D4 v.1 (SEQ ID NO: 274) and 109P1D4 v.8 (SEQ ID NO: 275)
Score = 5664 bits (2946), Expect = 0.0 Identibes = 3000/3027 (99%) Strand = Plus/Plus

```
V.1:  2532  cagaatgacaatagcccagttttcactcacaatgaatacaactttctatgtcccagaaaac  2591
            ||||||||||||||||||||||||||||||||||||||  |||||||||||||||||||||
V.8:  2517  cagaatgacaatagcccagttttcactcacaatgaatacaaattctatgtcccagaaaac  2576

V.1:  2592  cttccaaggcatggtacagtaggactaatcactgtaactgatcctgattatggagacaat  2651
            ||||||||||||||||||||||||||||||||||||||||||||||||||||||||||||
V.8:  2577  cttccaaggcatggtacagtaggactaatcactgtaactgatcctgattatggagacaat  2636

V.1:  2652  tctgcagttacgctctccattttagatgagaatgatgacttcaccattgattcacaaact  2711
            ||||||||||||||||||||||||||||||||||||||||||||||||||||||||||||
V.8:  2637  tctgcagttacgctctccattttagatgagaatgatgacttcaccattgattcacaaact  2696

V.1:  2712  ggtgtcatccgaccaaatatttcatttgatagagaaaaacaagaatcttacactttctat  2771
            ||||||||||||||||||||||||||||||||||||||||||||||||||||||||||||
V.8:  2697  tctgcagttacgctctccattttagatgagaatgatgacttcaccattgattcacaaact  2756

V.1:  2772  gtaaaggctgaggatggtggtagagtatcacgttcttcaagtgccaaagtaaccataaat  2831
            ||||||||||||||||||||||||||||||||||||||||||||||||||||||||||||
V.8:  2757  gtaaaggctgaggatggtggtagagtatcacgttcttcaagtgccaaagtaaccataaat  2816

V.1:  2832  gtggttgatgtcaatgacaacaaaccagttttcattgtcctccttccaactgttcttat  2891
            |||||||||||||||||||||||||||||||||||||||||||||||||   |||||||
V.8:  2817  gtggttgatgtcaatgacaacaaaccagttttcattgtccctccttacaactattcttat  2876

V.1:  2892  gaattggttctaccgtccactaatccaggcacagtggtctttcaggtaattgctgttgac  2951
            ||||||||||||||||||||||||||||||||||||||||||||||||||||||||||||
V.8:  2877  gaattggttctaccgtccactaatccaggcacagtggtctttcaggtaattgctgttgac  2936

V.1:  2952  aatgacactggcatgaatgcagaggttcgttacagcattgtaggaggaaacacaagagat  3011
            ||||||||||||||||||||||||||||||||||||||||||||||||||||||||||||
V.8:  2937  aatgacactggcatgaatgcagaggttcgttacagcattgtaggaggaaacacaagagat  2996

V.1:  3012  ctgtttgcaatcgaccaagaaacaggcaacataacattgatggagaaatgtgatgttaca  3071
            ||||||||||||||||||||||||||||||||||||||||||||||||||||||||||||
V.8:  2997  ctgtttgcaatcgaccaagaaacaggcaacataacattgatggagaaatgtgatgttaca  3056

V.1:  3072  gaccttggtttacacagagtgttggtcaaagctaatgacttaggacagcctgattctctc  3131
            ||||||||||||||||||||||||||||||||||||||||||||||||||||||||||||
V.8:  3057  gaccttggtttacacagagtgttggtcaaagctaatgacttaggacagcctgattctctc  3116

V.1:  3132  ttcagtgttgtaattgtcaatctgttcgtgaatgagtcggtgaccaatgctacactgatt  3191
            ||||||||||||||||||||||||||||||||||||||||||||||||||||||||||||
V.8:  3117  ttcagtgttgtaattgtcaatctgttcgtgaatgagtcagtgaccaatgctacactgatt  3176

V.1:  3192  aatgaactggtgcgcaaaagcactgaagcaccagtgaccccaaatactgagatagctgat  3251
            ||||||||||||||||||||||||||||||||||||||||||||||||||||||||||||
V.8:  3177  aatgaactggtgcgcaaaagcattgaagcaccagtgaccccaaatactgagatagctgat  3236

V.1:  3252  gtatcctcaccaactagtgactatgtcaagatcctggttgcagctgttgctggcaccata  3311
            ||||||||||||||||||||||||||||||||||||||||||||||||||||||||||||
V.8:  3237  gtatcctcaccaactagtgactatgtcaagatcctggttgcagctgttgctggcaccata  3296

V.1:  3312  actgtcgttgtagttattttcatcactgctgtagtaagatgtcgccaggcaccacacctt  3371
            ||||||||||||||||||||||||||||||||||||||||||||||||||||||||||||
V.8:  3297  actgtcgttgtagttattttcatcactgctgtagtaagatgtcgccaggcaccacacctt  3356

V.1:  3372  aaggctgctcagaaaaacaagcagaattctgaatgggctaccccaaacccagaaaacagg  3431
            |||||||||||||||||| |||||||||||||||||||||||||||||||||||||||||
V.8:  3357  aaggctgctcagaaaaacatgcagaattctgaatgggctaccccaaacccagaaaacagg  3416

V.1:  3432  cagatgataatgatgaagaaaagaaaagaagaagaagcattcccctaagaacttgctg   3491
            ||||||||||||||||||||||||||||||||||||||||||||||||||||| |||||
V.8:  3417  cagatgataatgatgaagaaaagaaaagaagaagaagcattcccctaagaacctgctg   3476

V.1:  3492  cttaattttgtcactattgaagaaactaaggcagatgatgttgacagtgatggaaacaga  3551
            ||||||  ||||||||||||||||||||||||||||||||||||||||||||||||||||
V.8:  3477  cttaatgttgtcactattgaagaaactaaggcagatgatgttgacagtgatggaaacaga  3536

V.1:  3552  gtcacactagaccttcctattgatctagaagagcaaacaatgggaaagtacaattgggta  3611
            ||||||||| ||||||||||||||||||||||||||||||||||||||||||||||||||
V.8:  3537  gtcacactagaccttcctattgatctagaagagcaaacaatgggaaagtacaattgggta  3596

V.1:  3612  actacacctactactttcaagcccgacagccctgatttggcccgacactacaaatctgcc  3671
            ||||||||||||||||||||| || ||||||||||||||||||||||||||||||||||
V.8:  3597  actacacctactactttcaagcctgacagccctgatttggcccgacactacaaatctgcc  3656
```

TABLE LIII(g)-continued

Nucleotide sequence alignment of 109P1D4 v.1 (SEQ ID NO: 274) and 109P1D4 v.8 (SEQ ID NO: 275)
Score = 5664 bits (2946), Expect = 0.0 Identibes = 3000/3027 (99%) Strand = Plus/Plus

```
V.1:  3672  tctccacagcctgccttccaaattcagcctgaaactcccctgaattcgaagcaccacatc  3731
            ||||||||||||||||||||||||||||||||||||||||||||| ||||||||||||||
V.8:  3657  tctccacagcctgccttccaaattcagcctgaaactcccctgaatttgaagcaccacatc  3716

V.1:  3732  atccaagaactgcctctcgataacacctttgtggcctgtgactctatctccaagtgttcc  3791
            ||||||||||||||||||||||||||||||||||||||||||||||||||||| ||||||
V.8:  3717  atccaagaactgcctctcgataacacctttgtggcctgtgactctatctccaattgttcc  3776

V.1:  3792  tcaagcagttcagatccctacagcgtttctgactgtggctatccagtgacgaccttcgag  3851
            |||||||||||||||||||||||||||||||||||||||||||||||||||| |||||||
V.8:  3777  tcaagcagttcagatccctacagcgtttctgactgtggctatccagtgacaaccttcgag  3836

V.1:  3852  gtacctgtgtccgtacacaccagaccg                                   3878
            |||||||||||||||||||||||||||
V.8:  3837  gtacctgtgtccgtacacaccagaccg                                   3863
```

Score = 1567 bits (815), Except = 0.0 Identifies = 829/836 (99%) Strand = Plus/Plus

```
V.1:     3  ggtggtccagtacctccaaagatatggaatacactcctgaaatatcctgaaaactttttt   62
            ||||||||||||||||||||||||||||||||||||||||||||||||||||| ||||||
V.8:     1  ggtggtccagtacctccaaagatatggaatacactcctgaaatatcctgaaacctttttt   60

V.1:    63  ttttcagaatcctttaataagcagttatgtcaatctgaaagttgcttacttgtactttat  122
            ||||||||||||||||||||||||||||||||||||||||||||||||||||||||||||
V.8:    61  ttttcagaatcctttaataagcagttatgtcaatctgaaagttgcttacttgtactttat  120

V.1:   123  attaatagctattcttgtttttcttatccaaagaaaaatcctctaatccccttttcacat  182
            ||||||||||||||||||||||||||||||||||||||||||||||||||||||||||||
V.8:   121  attaatagctattcttgtttttcttatccaaagaaaaatcctctaatccccttttcacat  180

V.1:   183  gatagttgttaccatgtttaggcattagtcacatcaaccctctcctctcccaaacttct   242
            ||||||||||||||||||||||||||| |||||||||||||||||||||||||||||||||
V.8:   181  gatagttgttaccatgtttaggcgttagtcacatcaaccctctcctctcccaaacttct   240

V.1:   243  cttcttcaaatcaaactttattagtccctcctttataatgattccttgcctcgtttatc  302
            |||||||||||||||||||||||||||||||||||||||||||||||||||||| |||||
V.8:   241  cttcttcaaatcaaactttattagtccctcctttataatgattccttgcctccttttatc  300

V.1:   303  cagatcaattttttttcactttgatgcccagagctgaagaaatggactactgtataaatt  362
            |||||||||||||||||||||||||||||||||||||||||||||||||||| |||||||
V.8:   301  cagatcaattttttttcactttgatgcccagagctgaagaaatggactattgtataaatt  360

V.1:   363  attcattgccaagagaataattgcattttaaacccatattataacaaagaataatgatta  422
            |||||||||||||||||||||||||||||||||||||| |||||||||||||||||||||
V.8:   361  attcattgccaagagaataattgcattttaaacccatgttataacaaagaataatgatta  420

V.1:   423  tattttgtgatttgtaacaaataccctttattttcccttaactattgaattaaatatttt  482
            ||||||||||||||||||||||||||||||||||||||||||||||||||||||||||||
V.8:   421  tattttgtgatttgtaacaaataccctttattttcccttaactattgaattaaatatttt  480

V.1:   483  aattatttgtattctctttaactatcttggtatattaaagtattatcttttatatattta  542
            ||||||||||||||||||||||||||||||||||||||||||||||||||||||||||||
V.8:   481  aattatttgtattctctttaactatcttggtatattaaagtattatcttttatatattta  540

V.1:   543  tcaatggtggacactttataggtactctgtgtcattttgatactgtaggtatcttatt   602
            ||||||||||||||||||||||||||||||||||||||||||||||||||||||||||
V.8:   541  tcaatggtggacactttataggtactctgtgtcattttgatactgtaggtatcttatt   600

V.1:   603  tcatttatctttattcttaatgtacgaattcataatatttgattcagaacaaatttatca  662
            |||||||||||||||||||||||||||||||||||||||||||||||||||| |||||||
V.8:   601  tcatttatctttattcttaatgtacgaattcataatatttgattcagaacagatttatca  660

V.1:   663  ctaattaacagagtgtcaattatgctaacatctcatttactgattttaatttaaaacagt  722
            ||||||||||||||||||||||||||||||||||||||||||||||||||||||||||||
V.8:   661  ctaattaacagagtgtcaattatgctaacatctcatttactgattttaatttaaaacagt  720

V.1:   723  ttttgttaacatgcatgtttagggttggcttcttaataatttcttcttcctcttctctct  782
            ||||||||||||||||||||||||||||||||||||||||||||||||||||||||||||
V.8:   721  ttttgttaacatgcatgtttagggttggcttcttaataatttcttcttcctcttctctct  780
```

TABLE LIII(g)-continued

Nucleotide sequence alignment of 109P1D4 v.1 (SEQ ID NO: 274) and 109P1D4 v.8 (SEQ ID NO: 275)
Score = 5664 bits (2946), Expect = 0.0 Identibes = 3000/3027 (99%) Strand = Plus/Plus

```
V.1:  783 ctcctcttcttttggtcagtgttgtgcgggttaatacaacaaactgtaacaagtgt 838
          ||||||||||||||||||||||||||||||||||||||||||||||| ||||||||
V.8:  781 ctcctcttcttttggtcagtgttgtgcgggttaatacaacaaactgtcacaagtgt 836
```

TABLE LIV(g)

Peptide sequences of protein coded by 109P1D4 v.8 (SEQ ID NO: 276)

| | | | | | |
|---|---|---|---|---|---|
| MFRVGFLIIS | SSSSLSPLLL | VSVVRVNTTN | CHKCLLSGTY | IFAVLLVCVV | FHSGAQEKNY  60 |
| TIREEIPENV | LIGNLLKDLN | LSLIPNKSLT | TTMQFKLVYK | TGDVPLIRIE | EDTGEIFTTG 120 |
| ARIDREKLCA | GIPRDEHCFY | EVEVAILPDE | IFRLVKIRFL | IEDINDWAPL | FPATVINTSI 180 |
| PENSAINSKY | TLPAAVDPDV | GINGVQNYEL | IKSQNIFGLD | VIETPEGDKM | PQLIVQKELD 240 |
| REEKDTYVMK | VKVEDGGFPQ | RSSTAILQVS | VTDTNDNHPV | FKETEIEVSI | PENAPVGTSV 300 |
| TQLHATDADI | GENAKIHFSF | SNLVSNIARR | LFHLNATTGL | ITIKEPLDRE | ETPNHKLLVL 360 |
| ASDGGLMPAR | AMVLVNVTDV | NDNVPSIDIR | YIVNPVNDTV | VLSENIPLMT | KIALITVTDK 420 |
| DADHNGRVTC | FTDHEIPFRL | RPVFSNQFLL | ENAAYLDYES | TKEYAIKLLA | ADAGKPPLNQ 480 |
| SANLFTKVKD | ENDNAPVFTQ | SFVTVSTPEN | NSPGIQLMKV | SATDADSGPN | AEINYLLGPD 540 |
| APPEFSLDRR | TGMLTVVKKL | DREKEDKYLF | TILAKDNGVP | PLTSNVTVFV | SIIDQNDNSP 600 |
| VFTHNEYKFY | VPENLPRHGT | VGLITVTDPD | YGDNSAVTLS | ILDENDDFTI | DSQTGVIRPN 660 |
| ISFDREKQES | YTFYVKAEDG | GRVSRSSSAK | VTINVVDVND | NKPVFIVPPY | NYSYELVLPS 720 |
| TNPGTVVFQV | IAVDNDTGMN | AEVRYSIVGG | NTRDLFAIDQ | ETGNITLMEK | CDVTDLGLHR 780 |
| VLVKANDLGQ | PDSLFSVVIV | NLFVNESVTN | ATLINELVRK | SIEAPVTPNT | EIADVSSPTS 840 |
| DYVKILVAAV | AGTITVVVVI | FITAVVRCRQ | APHLKAAQKN | MQNSEWATPN | PENRQMIMMK 900 |
| KKKKKKKHSP | KNLLLNVVTI | EETKADDVDS | DGNRVTLDLP | IDLEEQTMGK | YNWVTTPTTF 960 |
| KPDSPDLARH | YKSASPQPAF | QIQPETPLNL | KHHIIQELPL | DNTFVACDSI | SNCSSSSSDP 1020 |
| YSVSDCGYPV | TTFEVPVSVH | TRPSQRRVTF | HLPEGSQESS | SDGGLGDHDA | GSLTSTSHGL 1080 |
| PLGYPQEEYF | DRATPSNRTE | GDGNSDPEST | FIPGLKKEIT | VQPTVEEASD | NCTQECLIYG 1140 |
| HSDACWMPAS | LDHSSSSQAQ | ASALCHSPPL | SQASTQHHSP | PVTQTIVLCH | SPPVTQTIAL 1200 |
| CHSPPPIQVS | ALHHSPPLVQ | GTALHHSPPS | AQASALCYSP | PLAQAAAISH | SSSLPQVIAL 1260 |
| HRSQAQSSVS | LQQGWVQGAN | GLCSVDQGVQ | GSATSQFYTM | SERLHPSDDS | IKVIPLTTFA 1320 |
| PRQQARPSRG | DSPIMETHPL | | | | 1340 |

TABLE LV(g)

Amino acid sequence alignment of 109P1D4 v.1 (SEQ ID NO: 277) and
109P1D4 v.8 (SEQ ID NO: 278) Score = 1961 bits (5081), Expect =
0.0 Identities = 992/1009 (98%), Positives = 995/1009 (98%)

```
V.1   3 LLSGTYIFAVLLACVVFHSGAQEKNYTIREEMPENVLIGDLLKDLNLSLIPNKSLTTANQ  62
        LLSGTYIFAVLL CVVFHSGAQEKNYTIREE+PENVLIG+LLKDLNLSLIPNKSLTT MQ
V.8  35 LLSGTYIFAVLLCVVFHSGAQEKNYTIREEIPENVLIGNLLKDLNLSLIPNKSLTTTMQ  94

V.1  63 FKLVYKTGDVPLIRIEEDTGEIFTTGARIDREKLCAGIPRDEHCFYEVEVAILPDEIFRL 122
        FKLVYKTGDVPLIRIEEDTGEIFTTGARIDREKLCAGIPRDEHCFYEVEVAILPDEIFRL
V.8  95 FKLVYKTGDVPLIRIEEDTGEIFTTGARIDREKLCAGIPRDEHCFYEVEVAILPDEIFRL 154

V.1 123 VKIRFLIEDINDNAPLFPATVINISIPENSAINSKYTLPAAVDPDVGINGVQNYELIKSQ 182
        VKIRFLIEDINDNAPLFPATVINISIPENSAINSKYTLPAAVDPDVGINGVQNYELIKSQ
V.8 155 VKIRFLIEDINDNAPLFPATVINISIPENSAINSKYTLPAAVDPDVGINGVQNYELIKSQ 214
```

TABLE LV(g)-continued

Amino acid sequence alignment of 109P1D4 v.1 (SEQ ID NO: 277) and
109P1D4 v.8 (SEQ ID NO: 278) Score = 1961 bits (5081), Expect =
0.0Identities = 992/1009 (98%), Positives = 995/1009 (98%)

```
V.1 183 NIFGLDVIETPEGDKMPQLIVQKELDREEKDTYVMKVKVEDGGFPQRSSTAILQVSVTDT 242
        NIFGLDVIETPEGDKMPQLIVQKELDREEKDTYVMKVKVEDGGFPQRSSTAILQVSVTDT
V.8 215 NIFGLDVIETPEGDKMPQLIVQKELDREEKDTYVMKVKVEDGGFPQRSSTAILQVSVTDT 274

V.1 243 NDNHPVFKETEIEVSIPENAPVGTSVTQLMATDADIZENAKIHFSFSNLVSNIARRLFHL 302
        NDNHPVFKETEIEVSIPENAPVGTSVTQLHATDADIGENAKIHFSFSNLVSNIARRLFHL
V.8 275 NDNHPVFKETEIEVSIPENAPVGTSVTQLHATDADIGENAKIHFSFSNLVSNIARRLFHL 334

V.1 303 NATTGLITIKEPLDREETPNHKLLVLASDGGLMPARANVLVNTDVNDNVPSIDIRYIVN 362
        NATTGLITIKEPLDREETPNHKLLVLASDGGLMPARAMVLVNTDVNDNVPSIDIRYIVN
V.8 335 NATTGLITIKEPLDREETPNHKLLVLASDGGLMPARANVLVNTDVNDNVPSIDIRYIVN 394

V.1 363 PVNDTVVLSENIPLNTKIALITVTDKDADHNGRVTCFTDHEIPFRLRPVFSNQFLLETAA 422
        PVNDTVVLSENIPLNTKIALITVTDKDADHNGRVTCFTDHEIPFRLRPVFSNQFLLE AA
V.8 395 PVNDTVVLSENIPLNTKIALITVTDKDADHNGRVTCFTDHEIPFRLRPVFSNQFLLENAA 454

V.1 423 YLDYESTKEYAIKLLAADAGKPPLNQSAMLFIKVKDENDNAPVFTQSFVTVSIPENNSPG 482
        YLDYESTKEYAIKLLAADAGKPPLNQSAMLFIKVKDENDNAPVFTQSFVTVSIPENNSPG
V.8 455 YLDYESTKEYAIKLLAADAGKPPLNQSAMLFIKVKDENDNAPVFTQSFVTVSIPENNSPG 514

V.1 483 IQLTKVSANDADSGPNAKINYLLGPDAPPEFSLDCRTGMLTVVKKLDREKEDKYLFTILA 542
        IQL KVSA DADSGPNA+INYLLGPDAPPEFSLD RTGMLTVVKKLDREKEDKYLFTILA
V.8 515 IQLMKVSATDADSGPNAEINYLLGPDAPPEFSLDRRTGMLTVVKKLDREKEDKYLFTILA 574

V.1 543 KDNGVPPLTSNVTVFVSIIDQNDNSPVFTHNEYNFYVPENLPRHGTVGLITVTDPDYGDN 602
        KDNGVPPLTSNVTVFVSIIDQNDNSPVFTHNEY FYVPENLPRHGTVGLITVTDPDYGDN
V.8 575 KDNGVPPLTSNVTVFVSIIDQNDNSPVFTHNEYKFYVPENLPRHGTVGLITVTDPDYGDN 634

V.1 603 SAVTLSILDENDDFTIDSQTGVIRPNISFDREKQESYTFYVKAEDGGRVSRSSSAKVTIN 662
        SAVTLSILDENDDFTIDSQTGVIRPNISFDREKQESYTFYVKAEDGGRVSRSSSAKVTIN
V.8 635 SAVTLSILDENDDFTIDSQTGVIRPNISFDREKQESYTFYVKAEDGGRVSRSSSAKVTIN 694

V.1 663 VVDVNDNKPVFIVPPSNCSYELVLPSTNPGTVVFQVIAVDNDTGMNAEVRYSIVGGNTRD 722
        VVDVNDNKPVFIVPP N SYELVLPSTNPGTVVFQVIAVDNDTGMNAEVRYSIVGGNTRD
V.8 695 VVDVNDNKPVFIVPPYNYSYELVLPSTNPGTVVFQVIAVDNDTGMNAEVRYSIVGGNTRD 754

V.1 723 LFAIDQETGNITLMEKCDVTDLGLMRVLVKANDLGQPDSLFSVVIVNLFVNESVTNATLI 782
        LFAIDQETGNITLMEKCDVTDLGLHRVLVKANDLGQPDSLFSVVIVNLFVNESVTNATLI
V.8 755 LFAIDQETGNITLMEKCDVTDLGLMRVLVKANDLGQPDSLFSVVIVNLFVNESVTNATLI 814

V.1 783 NELVRKSTEAPVTPNTEIADVSSPTSDYVKILVAAVAGTITVVVVIFITAVVRCRQAPHL 842
        NELVRKS EAPVTPNTEIADVSSPTSDYVKILVAAVAGTITVVVVIFITAVVRCRQAPHL
V.8 815 NELVRKSIEAPVTPNTEIADVSSPTSDYVKILVAAVAGTITVVVVIFITAVVRCRQAPHL 874

V.1 843 KAAQKNKQNSEWATPNPENRQMIMMKKXKKKKKHSPKNLLLNFVTIEETKADDVDSDGNR 902
        KAAQKN QNSEWATPNPENRQMIMMKKKKKKKKHSPKNLLLN VTIEETKADDVDSDGNR
V.8 875 KAAQKNMQNSEWATPNPENRQMIMMKKKKKKKKHSPKNLLLNVVTIEETKADDVDSDGNR 934

V.1 903 VTLDLPIDLEEQTMGKYNWVTTPTTFKPDSPDLARHYKSASPQPAFQIQPETPLNSKHHI 962
        VTLDLPIDLEEQTMGKYNWVTTPTTFKPDSPDLARHYKSASPQPAFQIQPETPLN KHHI
V.8 935 VTLDLPIDLEEQTMGKYNWVTTPTTFKPDSPDLARHYKSASPQPAFQIQPETPLNLKHMI 994

V.1 963 IQELPLDNTFVACDSISKCSSSSSDPYSVSDCGYPVTTFEVPVSVNTRP 1011
        IQELPLDNTFVACDSIS CSSSSSDPYSVSDCGYPVTTFEVPVSVHTRP
V.8 995 IQELPLDNTFVACDSISNCSSSSSDPYSVSDCGYPVTTFEVPVSVHTRP 1043
```

TABLE LII(h)

Nucleotide sequence of transcript variant 109P1D4 v.9 (SEQ ID NO: 279)

| | | | | | |
|---|---|---|---|---|---|
| cccctttctc | ccctctgtt | aagtccctcc | ccctcgccat | tcaaaagggc | tggctcggca | 60 |
| ctggctcctt | gcagtcggcg | aactgtctgg | gcgggaggag | ccgtgagcag | tagctgcact | 120 |
| cagctgcccg | cgcggcaaag | aggaaggcaa | gccaaacaga | gtgcgcagag | tggcagtgcc | 180 |
| agcggcgaca | caggcagcac | aggcagcccg | ggctgcctga | atagcctcag | aaacaacctc | 240 |
| agcgactccg | gctgctctgc | ggactgcgag | ctgtggcggt | agagcccgct | acagcagtcg | 300 |
| cagtctccgt | ggagcgggcg | gaagcctttt | ttctccctt | cgtttacctc | ttcattctac | 360 |
| tctaaaggca | tcgttattag | gaaaatcctg | ttgtgaataa | gaaggattcc | acagatcaca | 420 |

TABLE LII(h)-continued

Nucleotide sequence of transcript variant 109P1D4 v.9 (SEQ ID NO: 279)

```
taccagagcg gttttgcctc agctgctctc aactttgtaa tcttgtgaag aagctgacaa    480
gcttggctga ttgcagtgca ctatgaggac tgaatgacag tgggttttaa ttcagatatt    540
tcaagtgttg tgcgggttaa tacaacaaac tgtcacaagt gtttgttgtc cgggacgtac    600
attttcgcgg tcctgctagt atgcgtggtg ttccactctg cgcccagga gaaaaactac    660
accatccgag aagaaattcc agaaaacgtc ctgataggca acttgttgaa agaccttaac    720
ttgtcgctga ttccaaacaa gtccttgaca actactatgc agttcaagct agtgtacaag    780
accggagatg tgccactgat tcgaattgaa gaggatactg gtgagatctt cactaccggc    840
gctcgcattg atcgtgagaa attatgtgct ggtatcccaa gggatgagca ttgcttttat    900
gaagtggagg ttgccatttt gccggatgaa atatttagac tggttaagat acgttttctg    960
atagaagata taaatgataa tgcaccattg ttcccagcaa cagttatcaa catatcaatt   1020
ccagagaact cggctataaa ctctaaatat actctcccag cggctgttga tcctgacgta   1080
ggcataaacg gagttcaaaa ctacgaacta attaagagtc aaaacatttt tggcctcgat   1140
gtcattgaaa caccagaagg agacaagatg ccacaactga ttgttcaaaa ggagttagat   1200
agggaagaga aggatacctta tgtgatgaaa gtaaaggttg aagatggtgg cttccctcaa   1260
agatccagta ctgctatttt gcaagtaagt gttactgata caaatgacaa ccacccagtc   1320
tttaaggaga cagagattga agtcagtata ccagaaaatg ctcctgtagg cacttcagtg   1380
acacagctcc atgccacaga tgctgacata ggtgaaaatg ccaagatcca cttctctttc   1440
agcaatctag tctccaacat tgccaggaga ttatttcacc tcaatgccac cactggactt   1500
atcacaatca aagaaccact ggataggaa gaaacaccaa accacaagtt actggttttg   1560
gcaagtgatg gtggattgat gccagcaaga gcaatggtgc tggtaaatgt tacagatgtc   1620
aatgataatg tcccatccat tgacataaga tacatcgtca atcctgtcaa tgacacagtt   1680
gttctttcag aaaatattcc actcaacacc aaaattgctc tcataactgt gacggataag   1740
gatgcggacc ataatggcag ggtgacatgc ttcacagatc atgaaattcc tttcagatta   1800
aggccagtat tcagtaatca gttcctcctg gagaatgcag catatcttga ctatgagtcc   1860
acaaaagaat atgccattaa attactggct gcagatgctg gcaaacctcc tttgaatcag   1920
tcagcaatgc tcttcatcaa agtgaaagat gaaaatgaca atgctccagt tttcacccag   1980
tctttcgtaa ctgttttctat tcctgagaat aactctcctg gcatccagtt gatgaaagta   2040
agtgcaacgg atgcagacag tgggcctaat gctgagatca attacctgct aggccctgat   2100
gctccacctg aattcagcct ggatcgtcgt acaggcatgc tgactgtagt gaagaaacta   2160
gatagagaaa aagaggataa atatttattc acaattctgg caaaagataa tggggtacca   2220
cccttaacca gcaatgtcac agtctttgta agcattattg atcagaatga caatagccca   2280
gttttcactc acaatgaata caattctat gtcccagaaa accttccaag gcatggtaca   2340
gtaggactaa tcactgtaac tgatcctgat tatggagaca attctgcagt tacgctctcc   2400
attttagatg agaatgatga cttcaccatt gattcacaaa ctggtgtcat ccgaccaaat   2460
atttcatttg atagagaaaa acaagaatct tacactttct atgtaaaggc tgaggatggt   2520
ggtagagtat cacgttcttc aagtgccaaa gtaaccataa atgtggttga tgtcaatgac   2580
aacaaaccag ttttcattgt ccctccttac aactattctt atgaattggt tctaccgtcc   2640
actaatccag gcacagtggt ctttcaggta attgctgttg acaatgacac tggcatgaat   2700
gcagaggttc gttacagcat tgtaggagga acacaagag atctgtttgc aatcgaccaa   2760
```

TABLE LII(h)-continued

Nucleotide sequence of transcript variant 109P1D4 v.9 (SEQ ID NO: 279)

```
gaaacaggca acataacatt gatggagaaa tgtgatgtta cagaccttgg tttacacaga   2820
gtgttggtca aagctaatga cttaggacag cctgattctc tcttcagtgt tgtaattgtc   2880
aatctgttcg tgaatgagtc agtgaccaat gctacactga ttaatgaact ggtgcgcaaa   2940
agcattgaag caccagtgac cccaaatact gagatagctg atgtatcctc accaactagt   3000
gactatgtca agatcctggt tgcagctgtt gctggcacca taactgtcgt tgtagttatt   3060
ttcatcactg ctgtagtaag atgtcgccag gcaccacacc ttaaggctgc tcagaaaaac   3120
atgcagaatt ctgaatgggc tacccaaac ccagaaaaca ggcagatgat aatgatgaag   3180
aaaaagaaaa agaagaagaa gcattcccct aagaacctgc tgcttaatgt tgtcactatt   3240
gaagaaacta aggcagatga tgttgacagt gatggaaaca gagtcacact agaccttcct   3300
attgatctag aagagcaaac aatgggaaag tacaattggg taactacacc tactactttc   3360
aagcctgaca gccctgattt ggcccgacac tacaaatctg cctctccaca gcctgccttc   3420
caaattcagc ctgaaactcc cctgaatttg aagcaccaca tcatccaaga actgcctctc   3480
gataacacct ttgtggcctg tgactctatc tccaattgtt cctcaagcag ttcagatccc   3540
tacagcgttt ctgactgtgg ctatccagtg acaaccttcg aggtacctgt gtccgtacac   3600
accagaccga ctgattccag gacatgaact attgaaatct gcagtgagat gtaactttct   3660
aggaacaaca aaattccatt cccttccaa aaatttcaa tgattgtgat ttcaaaatta   3720
ggctaagatc attaattttg taatctagat ttcccattat aaaagcaagc aaaaatcatc   3780
ttaaaaatga tgtcctagtg aaccttgtgc tttctttagc tgtaatctgg caatggaaat   3840
ttaaaattta tggaagagac agtgcagcgc aataacagag tactctcatg ctgtttctct   3900
gtttgctctg aatcaacagc catgatgtaa tataaggctg tcttggtgta tacacttatg   3960
gttaatatat cagtcatgaa acatgcaatt acttgccctg tctgattgtt gaataattaa   4020
aacattatct ccaggagttt ggaagtgagc tgaactagcc aaactactct ctgaaaggta   4080
tccagggcaa gagacatttt taagaccccca aacaaacaaa aaacaaaacc aaaacactct   4140
ggttcagtgt tttgaaaata ttgactaaca taatattgct gagaaaatca tttttattac   4200
ccaccactct gcttaaaagt tgagtgggcc gggcgcggtg gctcacgcct gtaattccag   4260
cactttggga ggccgaggcg ggtggatcac gaggtcagga tattgagacc atcctggcta   4320
acatggtgaa accccatctc cactaaaaat acaaaaaatt agctgggcgt ggtggcgggc   4380
gcctgtagtc ccagctactc gggaggctga ggcaggagaa tggcgtgaac ccgggaggcg   4440
gagcttgcag tgagccgaga tggcgccact gcactccagc ctgggtgaca gagcaagact   4500
ctgtctcaaa aagaaaaaaa tgttcagtga tagaaaataa ttttactagg tttttatgtt   4560
gattgtactc atgctgttcc actccttta attattaaaa agttattttt ggctgggtgt   4620
ggtggctcat acctgtaatc ccagcacttt gggaggccga ggcgggtgga tcacctgagg   4680
tcaggagttc aagaccagtc tggccaacat                                   4710
```

TABLE LIII(h)

Nucleotide sequence alignment of 109P1D4 v.1 (SEQ ID NO: 280) and 109P1D4 v.9 (SEQ ID NO: 281)
Score = 5664 bits (2946), Expect = 0.0 Identities = 3000/3027 (99%) Strand = Plus / Plus

```
V.1:   852  ttgttgtccgggacgtacattttcgcggtcctgctagcatgcgtggtgttccactctggc   911
            ||||||||||||||||||||||||||||||||||||||| |||||||||||||||||||
V.8:   583  ttgttgtccgggacgtacattttcgcggtcctgctagtatgcgtggtgttccactctggc   642
```

TABLE LIII(h)-continued

Nucleotide sequence alignment of 109P1D4 v.1 (SEQ ID NO: 280) and 109P1D4 v.9 (SEQ ID NO: 281)
Score = 5664 bits (2946), Expect = 0.0 Identities = 3000/3027 (99%) Strand = Plus / Plus

```
V.1:   912  gcccaggagaaaaactacaccatccgagaagaaatgccagaaaacgtcctgataggcgac   971
            ||||||||||||||||||||||||||||||||||| |||||||||||||||||||||| |
V.8:   643  gcccaggagaaaaactacaccatccgagaagaaattccagaaaacgtcctgataggcaac   702

V.1:   972  ttgttgaaagaccttaacttgtcgctgattccaaacaagtccttgacaactgctatgcag  1031
            |||||||||||||||||||||||||||||||||||||||||||||||||||| |||||||
V.8:   703  ttgttgaaagaccttaacttgtcgctgattccaaacaagtccttgacaactactatgcag   762

V.1:  1032  ttcaagctagtgtacaagaccggagatgtgccactgattcgaattgaagaggatactggt  1091
            ||||||||||||||||||||||||||||||||||||||||||||||||||||||||||||
V.8:   763  ttcaagctagtgtacaagaccggagatgtgccactgattcgaattgaagaggatactggt   822

V.1:  1092  gagatcttcactactggcgctcgcattgatcgtgagaaattatgtgctggtatcccaagg  1151
            |||||||||||| || ||||||||||||||||||||||||||||||||||||||||||||
V.8:   823  gagatcttcactaccggcgctcgcattgatcgtgagaaattatgtgctggtatcccaagg   882

V.1:  1152  gatgagcattgcttttatgaagtggaggttgccattttgccggatgaaatatttagactg  1211
            ||||||||||||||||||||||||||||||||||||||||||||||||||||||||||||
V.8:   883  gatgagcattgcttttatgaagtggaggttgccattttgccggatgaaatatttagactg   942

V.1:  1212  gttaagatacgttttctgatagaagatataaatgataatgcaccattgttcccagcaaca  1271
            ||||||||||||||||||||||||||||||||||||||||||||||||||||||||||||
V.9:   943  gttaagatacgttttctgatagaagatataaatgataatgcaccattgttcccagcaaca  1002

V.1:  1272  gttatcaacatatcaattccagagaactcggctataaactctaaatatactctcccagcg  1331
            ||||||||||||||||||||||||||||||||||||||||||||||||||||||||||||
V.9:  1003  gttatcaacatatcaattccagagaactcggctataaactctaaatatactctcccagcg  1062

V.1:  1332  gctgttgatcctgacgtaggaataaacggagttcaaaactacgaactaattaagagtcaa  1391
            |||||||||||||||||||| |||||||||||||||||||||||||||||||||||||||
V.9:  1063  gctgttgatcctgacgtaggcataaacggagttcaaaactacgaactaattaagagtcaa  1122

V.1:  1392  aacattttggcctcgatgtcattgaaacaccagaaggagacaagatgccacaactgatt  1451
            ||||||||||||||||||||||||||||||||||||||||||||||||||||||||||||
V.9:  1123  aacattttggcctcgatgtcattgaaacaccagaaggagacaagatgccacaactgatt  1182

V.1:  1452  gttcaaaaggagttagatagggaagagaaggatacctacgtgatgaaagtaaaggttgaa  1511
            |||||||||||||||||||||||||||||||||||||| |||||||||||||||||||||
V.9:  1183  gttcaaaaggagttagatagggaagagaaggatacctatgtgatgaaagtaaaggttgaa  1242

V.1:  1512  gatggtggctttcctcaaagatccagtactgctattttgcaagtgagtgttactgataca  1571
            |||||||||||||||||||||||||||||||||||||||||||| |||||||||||||||
V.9:  1243  gatggtggctttcctcaaagatccagtactgctattttgcaagtaagtgttactgataca  1302

V.1:  1572  aatgacaaccacccagtctttaaggagacagagattgaagtcagtataccagaaaatgct  1631
            ||||||||||||||||||||||||||||||||||||||||||||||||||||||||||||
V.9:  1303  aatgacaaccacccagtctttaaggagacagagattgaagtcagtataccagaaaatgct  1362

V.1:  1632  cctgtaggcacttcagtgacacagctccatgccacagatgctgacataggtgaaaatgcc  1691
            ||||||||||||||||||||||||||||||||||||||||||||||||||||||||||||
V.9:  1363  cctgtaggcacttcagtgacacagctccatgccacagatgctgacataggtgaaaatgcc  1422

V.1:  1692  aagatccacttctctttcagcaatctagtctccaacattgccaggagattatttcacctc  1751
            ||||||||||||||||||||||||||||||||||||||||||||||||||||||||||||
V.9:  1423  aagatccacttctctttcagcaatctagtctccaacattgccaggagattatttcacctc  1482

V.1:  1752  aatgccaccactggacttatcacaatcaaagaaccactggatagggaagaaacaccaaac  1811
            ||||||||||||||||||||||||||||||||||||||||||||||||||||||||||||
V.9:  1483  aatgccaccactggacttatcacaatcaaagaaccactggatagggaagaaacaccaaac  1542

V.1:  1812  cacaagttactggttttggcaagtgatggtggattgatgccagcaagagcaatggtgctg  1871
            ||||||||||||||||||||||||||||||||||||||||||||||||||||||||||||
V.9:  1543  cacaagttactggttttggcaagtgatggtggattgatgccagcaagagcaatggtgctg  1602

V.1:  1872  gtaaatgttacagatgtcaatgataatgtcccatccattgacataagatacatcgtcaat  1931
            |||||||||||||| |||||||||||||||||||||||||||||||||||||||||||||
V.9:  1603  gtaaatgttacagacgtcaatgataatgtcccatccattgacataagatacatcgtcaat  1662

V.1:  1932  cctgtcaatgacacagttgttctttcagaaaatattccactcaacaccaaaattgctctc  1991
            ||||||||||||||||||||||||||||||||||||||||||||||||||||||||||||
V.9:  1663  cctgtcaatgacacagttgttctttcagaaaatattccactcaacaccaaaattgctctc  1722

V.1:  1992  ataactgtgacggataaggatgcggaccataatggcagggtgacatgcttcacagatcat  2051
            ||||||||||||||||||||||||||||||||||||||||||||||||||||||||||||
V.9:  1723  ataactgtgacggataaggatgcggaccataatggcagggtgacatgcttcacagatcat  1782
```

TABLE LIII(h)-continued

Nucleotide sequence alignment of 109P1D4 v.1 (SEQ ID NO: 280) and 109P1D4 v.9 (SEQ ID NO: 281)
Score = 5664 bits (2946), Expect = 0.0 Identities = 3000/3027 (99%) Strand = Plus / Plus

```
V.1:  2052  gaaatcccctttcagattaaggccagtattcagtaatcagttcctcctggagactgcagca  2111
            |||||  |||||||||||||||||||||||||||||||||||||||||||| |||||||||
V.9:  1783  gaaattcctttcagattaaggccagtattcagtaatcagttcctcctggagaatgcagca  1842

V.1:  2112  tatcttgactatgagtccacaaaagaatatgccattaaattactggctgcagatgctggc  2171
            ||||||||||||||||||||||||||||||||||||||||||||||||||||||||||||
V.9:  1843  tatcttgactatgagtccacaaaagaatatgccattaaattactggctgcagatgctggc  1902

V.1:  2172  aaacctcctttgaatcagtcagcaatgctcttcatcaaagtgaaagatgaaaatgacaat  2231
            ||||||||||||||||||||||||||||||||||||||||||||||||||||||||||||
V.9:  1903  aaacctcctttgaatcagtcagcaatgctcttcatcaaagtgaaagatgaaaatgacaat  1962

V.1:  2232  gctccagttttcacccagtctttcgtaactgtttctattcctgagaataactctcctggc  2291
            ||||||||||||||||||||||||||||||||||||||||||||||||||||||||||||
V.9:  1963  gctccagttttcacccagtctttcgtaactgtttctattcctgagaataactctcctggc  2022

V.1:  2292  atccagttgacgaaagtaagtgcaatggatgcagacagtgggcctaatgctaagatcaat  2351
            |||||||||  |||||||||||||||  ||||||||||||||||||||||||| ||||||
V.9:  2023  atccagttgatgaaagtaagtgcaacggatgcagacagtgggcctaatgctgagatcaat  2082

V.1:  2352  tacctgctaggccctgatgctccacctgaattcagcctggattgtcgtacaggcatgctg  2411
            |||||||||||||||||||||||||||||||||||||||| |||| ||||||||||||||
V.9:  2083  tacctgctaggccctgatgctccacctgaattcagcctggatcgtcgtacaggcatgctg  2142

V.1:  2412  actgtagtgaagaaactagatagagaaaaagaggataaatatttattcacaattctggca  2471
            ||||||||||||||||||||||||||||||||||||||||||||||||||||||||||||
V.9:  2143  actgtagtgaagaaactagatagagaaaaagaggataaatatttattcacaattctggca  2202

V.1:  2472  aaagataacggggtaccacccttaaccagcaatgtcacagtctttgtaagcattattgat  2531
            ||||||||  ||||||||||||||||||||||||||||||||||||||||||||||||||
V.9:  2203  aaagataatggggtaccacccttaaccagcaatgtcacagtctttgtaagcattattgat  2262

V.1:  2532  cagaatgacaatagcccagttttcactcacaatgaatacaacttctatgtcccagaaaac  2591
            ||||||||||||||||||||||||||||||||||||||||| ||||||||||||||||||
V.9:  2263  cagaatgacaatagcccagttttcactcacaatgaatacaaattctatgtcccagaaaac  2322

V.1:  2592  cttccaaggcatggtacagtaggactaatcactgtaactgatcctgattatggagacaat  2651
            ||||||||||||||||||||||||||||||||||||||||||||||||||||||||||||
V.9:  2323  cttccaaggcatggtacagtaggactaatcactgtaactgatcctgattatggagacaat  2382

V.1:  2652  tctgcagttacgctctccattttagatgagaatgatgacttcaccattgattcacaaact  2711
            ||||||||||||||||||||||||||||||||||||||||||||||||||||||||||||
V.9:  2383  tctgcagttacgctctccattttagatgagaatgatgacttcaccattgattcacaaact  2442

V.1:  2712  ggtgtcatccgaccaaatatttcatttgatagagaaaaacaagaatcttacactttctat  2771
            ||||||||||||||||||||||||||||||||||||||||||||||||||||||||||||
V.9:  2443  ggtgtcatccgaccaaatatttcatttgatagagaaaaacaagaatcttacactttctat  2502

V.1:  2772  gtaaaggctgaggatggtggtagagtatcacgttcttcaagtgccaaagtaaccataaat  2831
            ||||||||||||||||||||||||||||||||||||||||||||||||||||||||||||
V.9:  2503  gtaaaggctgaggatggtggtagagtatcacgttcttcaagtgccaaagtaaccataaat  2562

V.1:  2832  gtggttgatgtcaatgacaacaaaccagttttcattgtccctccttccaactgttcttat  2891
            |||||||||||||||||||||||||||||||||||||||||||||||| |||| ||||||
V.9:  2563  gtggttgatgtcaatgacaacaaaccagttttcattgtccctccttacaactattcttat  2622

V.1:  2892  gaattggttctaccgtccactaatccaggcacagtggtctttcaggtaattgctgttgac  2951
            ||||||||||||||||||||||||||||||||||||||||||||||||||||||||||||
V.9:  2623  gaattggttctaccgtccactaatccaggcacagtggtctttcaggtaattgctgttgac  2682

V.1:  2952  aatgacactggcatgaatgcagaggttcgttacagcattgtaggaggaaacacaagagat  3011
            |||||||||||||||||||||||||||||||||||||||||||||||||||||||||||
V.9:  2683  aatgacactggcatgaatgcagaggttcgttacagcattgtaggaggaaacacaagagat  2742

V.1:  3012  ctgtttgcaatcgaccaagaaacaggcaacataacattgatggagaaatgtgatgttaca  3071
            ||||||||||||||||||||||||||||||||||||||||||||||||||||||||||||
V.9:  2743  ctgtttgcaatcgaccaagaaacaggcaacataacattgatggagaaatgtgatgttaca  2802

V.1:  3072  gaccttggtttacacagagtgttggtcaaagctaatgacttaggacagcctgattctctc  3131
            ||||||||||||||||||||||||||||||||||||||||||||||||||||||||||||
V.9:  2803  gaccttggtttacacagagtgttggtcaaagctaatgacttaggacagcctgattctctc  2862
```

TABLE LIII(h)-continued

Nucleotide sequence alignment of 109P1D4 v.1 (SEQ ID NO: 280) and 109P1D4 v.9 (SEQ ID NO: 281)
Score = 5664 bits (2946), Expect = 0.0 Identities = 3000/3027 (99%) Strand = Plus / Plus

```
V.1:  3132  ttcagtgttgtaattgtcaatctgttcgtgaatgagtcggtgaccaatgctacactgatt  3191
            ||||||||||||||||||||||||||||||||||||||| ||||||||||||||||||||
V.9:  2863  ttcagtgttgtaattgtcaatctgttcgtgaatgagtcagtgaccaatgctacactgatt  2922

V.1:  3192  aatgaactggtgcgcaaaagcactgaagcaccagtgaccccaaatactgagatagctgat  3251
            ||||||||||||||||||||||| |||||||||||||||||||||||||||||||||||
V.9:  2923  aatgaactggtgcgcaaaagcattgaagcaccagtgaccccaaatactgagatagctgat  2982

V.1:  3252  gtatcctcaccaactagtgactatgtcaagatcctggttgcagctgttgctggcaccata  3311
            ||||||||||||||||||||||||||||||||||||||||||||||||||||||||||||
V.9:  2983  gtatcctcaccaactagtgactatgtcaagatcctggttgcagctgttgctggcaccata  3042

V.1:  3312  actgtcgttgtagttatttttcatcactgctgtagtaagatgtcgccaggcaccacacctt  3371
            ||||||||||||||||||||||||||||||||||||||||||||||||||||||||||||
V.9:  3043  actgtcgttgtagttatttttcatcactgctgtagtaagatgtcgccaggcaccacacctt  3102

V.1:  3372  aaggctgctcagaaaaacaagcagaattctgaatgggctaccccaaacccagaaaacagg  3431
            |||||||||||||||||||| |||||||||||||||||||||||||||||||||||||||
V.9:  3103  aaggctgctcagaaaaacatgcagaattctgaatgggctaccccaaacccagaaaacagg  3162

V.1:  3432  cagatgataatgatgaagaaaaagaaaaagaagaagaagcattcccctaagaacttgctg  3491
            ||||||||||||||||||||||||||||||||||||||||||||||||||||||| ||||
V.9:  3163  cagatgataatgatgaagaaaaagaaaaagaagaagaagcattcccctaagaacctgctg  3222

V.1:  3492  cttaattttgtcactattgaagaaactaaggcagatgatgttgacagtgatggaaacaga  3551
            ||||| || ||||||||||||||||||||||||||||||||||||||||||||||||||
V.9:  3223  cttaatgttgtcactattgaagaaactaaggcagatgatgttgacagtgatggaaacaga  3282

V.1:  3612  actacacctactactttcaagcccgacagccctgatttggcccgacactacaaatctgcc  3671
            |||||||||||||||||||| |||||||||||||||||||||||||||||||||||||||
V.9:  3343  actacacctactactttcaagcctgacagccctgatttggcccgacactacaaatctgcc  3402

V.1:  3672  tctccacagcctgccttccaaattcagcctgaaactcccctgaattcgaagcaccacatc  3731
            ||||||||||||||||||||||||||||||||||||| |||||||| |||||||||||||
V.9:  3403  tctccacagcctgccttccaaattcagcctgaaactccccctgaatttgaagcaccacatc  3462

V.1:  3732  atccaagaactgcctctcgataacacctttctggcctgtgactctatctccaagtgttcc  3791
            ||||||||||||||||||||||||||||||||||||||||||||||||||||| ||||||
V.9:  3463  atccaagaactgcctctcgataacacctttctggcctgtgactctatctccaattgttcc  3522

V.1:  3792  tcaagcagttcagatccctacagcgtttctgactgtggctatccagtgacgaccttcgag  3851
            |||||||||||||||||||||||||||||||||||||||||||||||||||| |||||||
V.9:  3523  tcaagcagttcagatccctacagcgtttctgactgtggctatccagtgacaaccttcgag  3582

V.1:  3852  gtacctgtgtccgtacacaccagaccg                                   3878
            |||||||||||||||||||||||||||
V.9:  3583  gtacctgtgtccgtacacaccagaccg                                   3609
```

TABLE LIV(h)

Peptide sequences of protein coded by 109P1D4 v.9 (SEQ ID NO: 282)

```
MTVGFNSDIS SVVRVNTTNC HKCLLSGTYI FAVLLVCVVF HSGAQEKNYT IREEIPENVL    60

IGNLLKDLNL SLIPNKSLTT TMQFKLVYKT GDVPLIRIEE DTGEIFTTGA RIDREKLCAG   120

IPRDEHCFYE VEVAILPDEI FRLVKIRFLI EDINDNAPLF PATVINISIP ENSAINSKYT   180

LPAAVDPDVG INGVQNYELI KSQNIFGLDV IETPEGDKMP QLIVQKELDR EEKDTYVMKV   240

KVEDGGFPQR SSTAILQVSV TDTNDNHPVF KETEIEVSIP ENAPVGTSVT QLHATDADIG   300

ENAKIHFSFS NLVSNIARRL FHLNATTGLI TIKEPLDREE TPNHKLLVLA SDGGLMPARA   360

MVLVNVTDVN DNVPSIDIRY IVNPVNDTVV LSENIPLNTK IALITVTDKD ADHNGRVTCF   420

TDHEIPFRLR PVFSNQFLLE NAAYLDYEST KEYAIKLLAA DAGKPPLNQS ANLFIKVKDE   480

NDNAPVFTQS FVTVSIPENN SPGIQLMKVS ATDADSGPNA EINYLLGPDA PPEFSLDRRT   540

GMLTVVKKLD REKEDKYLFT ILAKDNGVPP LTSNVTVFVS IIDQNDNSPV FTHNEYKFYV   600

PENLPRHGTV GLITVTDPDY GDNSAVTLSI LDENDDFTID SQTGVIRPNI SFDREKQESY   660
```

TABLE LIV(h)-continued

Peptide sequences of protein coded by 109P1D4 v.9 (SEQ ID NO: 282)

```
TFYVKAEDGG RVSRSSSAKV TINVVDVNDN KPVFIVPPYN YSYELVLPST NPGTVVFQVI    720

AVDNDTGMNA EVRYSIVGGN TRDLFAIDQE TGNITLMEKC DVTDLGLHRV LVKANDLGQP    780

DSLFSVVIVN LFVNESVTNA TLINELVRKS IEAPVTPNTE IADVSSPTSD YVKILVAAVA    840

GTITVVVIF ITAVVRCRQA PHLKAAQKNM QNSEWATPNP ENRQMIMMKK KKKKKKHSPK     900

NLLLNVVTIE ETKADDVDSD GNRVTLDLPI DLEEQTMGKY NWVTTPTTFK PDSPDLARHY    960

KSASPQPAFQ IQPETPLNLK HHIIQELPLD NTFVACDSIS NCSSSSSDPY SVSDCGYPVT   1020

TFEVPVSVHT RPTDSRT                                                  1037
```

TABLE LV(h)

Amino acid sequence alignment of 109P1D4 v.1 (SEQ ID NO: 283) and 109P1D4 v.9 (SEQ ID NO: 284) Score = 1961 bits (5081), Expect = 0.0 Identities = 992/1009 (98%), Positives = 995/1009 (98%)

```
V.1   3 LLSGTYIFAVLLACVVFHSGAQEKNYTIREEMPENVLIGDLLKDLNLSLIPNKSLTTAMQ  62
        LLSGTYIFAVLL CVVFHSGAQEKNYTIREE+PENVLIG+LLKDLNLSLIPNKSLTT MQ
V.9  24 LLSGTYIFAVLLVCVVFHSGAQEKNYTIREEIPENVLIGNLLKDLNLSLIPNKSLTTTMQ  83

V.1  63 FKLVYKTGDVPLIRIEEDTGEIFTTGARIDREKLCAGIPRDEHCFYEVEVAILPDEIFRL  122
        FKLVYKTGDVPLIRIEEDTGEIFTTGARIDREKLCAGIPRDEHCFYEVEVAILPDEIFRL
V.9  84 FKLVYKTGDVPLIRIEEDTGEIFTTGARIDREKLCAGIPRDEHCFYEVEVAILPDEIFRL  143

V.1 123 VKIRFLIEDINDNAPLFPATVINISIPENSAINSKYTLPAAVDPDVGINGVQNYELIKSQ  182
        VKIRFLIEDINDNAPLFPATVINISIPENSAINSKYTLPAAVDPDVGINGVQNYELIKSQ
V.9 144 VKIRFLIEDINDNAPLFPATVINISIPENSAINSKYTLPAAVDPDVGINGVQNYELIKSQ  203

V.1 183 NIFGLDVIETPEGDKMPQLIVQKELDREEKDTYVNKVKVEDGGFPQRSSTAILQVSVTDT  242
        NIFGLDVIETPEGDKMPQLIVQKELDREEKDTYVMKVKVEDGGFPQRSSTAILQVSVTDT
V.9 204 NIFGLDVIETPEGDKMPQLIVQKELDREEKDTYVMKVKVEDGGFPQRSSTAILQVSVTDT  263

V.1 243 NDNHPVFKETEIEVSIPENAPVGTSVTQLHATDADIGENAKIHFSFSNLVSNIARRLFHL  302
        NDNHPVFKETEIEVSIPENAPVGTSVTQLHATDADIGENAKIHFSFSNLVSNIARRLFHL
V.9 264 NDNHPVFKETEIEVSIPENAPVGTSVTQLHATDADIGENAKIHFSFSNLVSNIARRLFHL  323

V.1 303 NATTGLITIKEPLDREETPNHKLLVLASDGGLMPARAMVLVNVTDVNDNVPSIDIRYIVN  362
        NATTGLITIKEPLDREETPNHKLLVLASDGGLMPARAMVLVNVTDVNDNVPSIDIRYIVN
V.9 324 NATTGLITIKEPLDREETPNHKLLVLASDGGLMPARAMVLVNVTDVNDNVPSIDIRYIVN  383

V.1 363 PVNDTVVLSENIPLNTKIALITVTDKDADHNGRVTCFTDHEIPFRLRPVFSNQFLLETAA  422
        PVNDTVVLSENIPLNTKIALITVTDKDADHNGRVTCFTDHEIPFRLRPVFSNQFLLE AA
V.9 384 PVNDTVVLSENIPLNTKIALITVTDKDADHNGRVTCFTDHEIPFRLRPVFSNQFLLENAA  443

V.1 423 YLDYESTKEYAIKLLAADAGKPPLNQSAMLFIKVKDENDNAPVFTOSFVTVSIPENNSPG  482
        YLDYESTKEYAIKLLAADAGKPPLNQSAMLFIKVKDENDNAPVFTQSFVTVSIPENNSPG
V.9 444 YLDYESTKEYAIKLLAADAGKPPLNQSAMLFIKVKDENDNAPVFTQSFVTVSIPENNSPG  503

V.1 483 IQLTKVSAMDADSGPNAKINYLLGPDAPPEFSLDCRTGMLTVVKKLDREKEDKYLFTILA  542
        IQL KVSA DADSGPNA+INYLLGPDAPPEFSLD RTGMLTVVKKLDREKEDKYLFTILA
V.9 504 IQLMKVSATDADSGPNAEINYLLGPDAPPEFSLDRRTGMLTVVKKLDREKEDKYLFTILA  563

V.1 543 KDNGVPPLTSNVTVFVSIIDQNDNSPVFTHNEYNFYVPENLPRMGTVGLITVTDPDYGDN  602
        KDNGVPPLTSNVTVFVSIIDQNDNSPVFTHNEY FYVPENLPRHGTVGLITVTDPDYGDN
V.9 564 KDNGVPPLTSNVTVFVSIIDQNDNSPVFTHNEYKFYVPENLPRHGTVGLITVTDPDYGDN  623

V.1 603 SAVTLSILDENDDFTIDSQTGVIRPNISFDREKQESYTFYVKAEDGGRVSRSSSAKVTIN  662
        SAVTLSILDENDDFTIDSQTGVIRPNISFDREKQESYTFYVKAEDGGRVSRSSSAKVTIN
V.9 624 SAVTLSILDENDDFTIDSQTGVIRPNISFDREKQESYTFYVKAEDGGRVSRSSSAKVTIN  683

V.1 663 VVDVNDNKPVFIVPPSNCSYELVLPSTNPGTVVFQVIAVDNDTGMNAEVRYSIVGGNTRD  722
        VVDVNDNKPVFIVPP N SYELVLPSTNPGTVVFQVIAVDNDTGMNAEVRYSIVGGNTRD
V.9 684 VVDVNDNKPVFIVPPYNYSYELVLPSTNPGTVVFQVIAVDNDTGMNAEVRYSIVGGNTRD  743

V.1 723 LFAIDQETGNITLMEKCDVTDLGLHRVLVKANDLGQPDSLFSVVIVNLFVNESVTNATLI  782
        LFAIDQETGNITLMEKCDVTDLGLHRVLVKANDLGQPDSLFSVVIVNLFVNESVTNATLI
V.9 744 LFAIDQETGNITLMEKCDVTDLGLHRVLVKANDLGQPDSLFSVVIVNLFVNESVTNATLI  803

V.1 783 NELVRKSTEAPVTPNTEIADVSSPTSDYVKILVAAVAGTITVVVVIFITAVVRCRQAPHL  842
        NELVRKS EAPVTPNTEIADVSSPTSDYVKILVAAVAGTITVVVVIFITAVVRCRQAPHL
```

TABLE LV(h)-continued

Amino acid sequence alignment of 109P1D4 v.1 (SEQ ID NO: 283) and 109P1D4 v.9 (SEQ ID NO: 284) Score = 1961 bits (5081), Expect = 0.0 Identities = 992/1009 (98%), Positives = 995/1009 (98%)

```
V.9 804 NELVRKSIEAPVTPNTEIADVSSPTSDYVKILVAAVAGTITVVVVIFITAVVRCRQAPHL 863

V.1 843 KAAQKNKQNSEWATPNPENRQMIMMKKKKKKKKHSPKNLLLNFVTIEETKADDVDSDGNR 902
        KAAQKN QNSEWATPNPENRQMIMMKKKKKKKKHSPKNLLLN VTIEETKADDVDSDGNR
V.9 864 KAAQKNMQNSEWATPNPENRQMIMMKKKKKKKKHSPKNLLLNVVTIEETKADDVDSDGNR 923

V.1 903 VTLDLPIDLEEQTMGKYNWVTTPTTFKPDSPDLARHYKSASPQPAFQIQPETPLNSKHHI 962
        VTLDLPIDLEEQTMGKYNWVTTPTTFKPDSPDLARHYKSASPQPAFQIQPETPLN KHHI
V.9 924 VTLDLPIDLEEQTMGKYNWVTTPTTFKPDSPDLARHYKSASPQPAFQIQPETPLNLKHHI 983

V.1 963 IQELPLDNTFVACDSISKCSSSSSDPYSVSDCGYPVTTFEVPVSVHTRP 1011
        IQELPLDNTFVACDSIS CSSSSSDPYSVSDCGYPVTTFEVPVSVHTRP
V.9 984 IQELPLDNTFVACDSISNCSSSSSDPYSVSDCGYPVTTFEVPVSVHTRP 1032
```

SEQUENCE LISTING (284 sequences)

SEQ ID NO: 1 - DNA, 192 bp, Homo sapiens
gatcctggttgcagctgttgctggcaccataactgtcgttgtagttattttcatcactgctgtagtaagatgtcgccaggcacacaccttaaggctgctcagaaaaacatgcagaattctgaatgggctaccccaaacccagaaaacaggcagatgataaaaaaaaaaaaaaaaaaaaaaaaaagcttgatc

SEQ ID NO: 2 - DNA, 4603 bp, Homo sapiens
  CDS (846)...(3911)
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattct

SEQ ID NO: 3 - protein, 1021 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPVGIQVSNTTF

SEQ ID NO: 4 - DNA, 4723 bp, Homo sapiens
  CDS (503)...(3667)
cccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgcgaataagaaggattccacagatcacataccggagaggttttgcctcagctgctctcaactttgtaatcttgtgaagaagctgacaagcttggctgattgcagagcactatgaggactgaacgacagtgggttttaattcagatatttcaagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgactgattccaggacatcaactattgaaatctgcagtgagatataactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcacaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattcactaacataatattgctgagaaaatcatttttattacccaccactctgcttaaaagttgagtgggccgggcgcggtggctcacgcctgtaatcccagcactttgggaggccgaggcgggtggatcacgaggtcaggagattgagaccatcctggctaacacggtgaaaccccatctccactaaaaatacaaaaaattagcctggcgtggtggcgggcgcctgtagtcccagctactcgggaggctgaggcaggagaatagcgtgaacccgggaggcggagcttgcagtgagccgagatggcgccactgcactccagcctgggtgacagagcaagactctgtctcaaaaagaaaaaaatgttcaatgatagaaaataattttactaggtttttatgttgattgtactcatgctgttccactccttttaattattaaaaagttatttttggctgggtgtggtggctcacacctgtaatcccagcactttgggaggccgaggtgggtggatcacctgaggtcaggagttcaagaccagtctggccaacat

SEQ ID NO: 5 - protein, 1054 aa, Homo sapiens
MRTERQWVLIQIFQVLCGLIQQTVTSVPGMDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPTDSRTSTIEICSEI

SEQ ID NO: 6 - DNA, 9176 bp, Homo sapiens
  CDS (846)...(4889)
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaat

SEQ ID NO: 7 - protein, 1347 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 8 - DNA, 9146 bp, Homo sapiens
  CDS (846)...(4859)
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaat

SEQ ID NO: 9 - protein, 1337 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 10 - DNA, 9065 bp, Homo sapiens
  CDS (846)...(4778)
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaat

SEQ ID NO: 11 - protein, 1310 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 12 - DNA, 4830 bp, Homo sapiens
  CDS (614)...(3727)
  misc_feature (0)...(0): n = a, t, c, or g
ggcagtcggcgaactgtctgggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattagagggtgcttaaaaagtacagatcaactggatggatgaatggatggaagaggatggaatatcttaacaaaacacattttccttaagtaaattcatgcatactccaaataaaatacagaatgtgaagtatctctgaactgtgctgttgaatatggtagctactagctacatgaaaatcctgttgtgaataagaaggattccacagatcacataccagagcggttttgcctcagctgctctcaactttgtaatcttgtgaagaagctgacaagcttggctgattgcagtgcactatgaggactgaatgacagtgggttttaattcagatatttcaagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaattttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaagtgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatggattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcacaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatcttccaggagtttggaagtgagctgaactagccaaactactctctgaaaggtatccagggcaagagacatttttaagaccccaaacaaacaaaaaacaaaaccaaaacactctggttcagtgttttgaaaatattcactaacataatattgctgagaaaatcatttttattacccaccactctgcttaaaagttgagtgggccgggcgcggtggctcacgcctgtaatcccagcactttgggaggccgaggcgggtggatcacgaggtcaggagattgagaccatcctggctaacacggtgaaaccccatctccactaaaaatacaaaaaattagcctggcgtggtggcgggcgcctgtagtcccagctactcgggaggctgaggcaggagaatagcgtgaacccgggaggcggagcttgcagtgagccgagatggcgccactctgcactccagcctgggtgacagagcaagactctgtctcaaaaagaaaaaaatgttcaatgatagaaaataattttactaggtttttatgttgattgtactcatggtgttccactccttttaattattaaaaagttatttttggggtgggtgtggtggctcacaccgtaatcccagcactttgggaggccgaggtgggtggatcacctgaggtcaggagttcaagaccagtntggccaacatggcgaaaccccgtttt

SEQ ID NO: 13 - protein, 1037 aa, Homo sapiens [sequence omitted]

SEQ ID NO: 14 - DNA, 4964 bp, Homo sapiens
  CDS (735)...(3881)
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattgactaacataatattgctgagaaaatcatttttattacccaccactctgcttaaaagttgagtgggccgggcgcggtggctcacgcctgtaattccagcactttgggaggccgaggcgggtggatcacgaggtcaggatattgagaccatcctggctaacatggtgaaaccccatctccactaaaaatacaaaaaattagctgggcgtggtggcgggcgcctgtagtcccagctactcgggaggctgaggcaggagaatggcgtgaacccgggaggcggagcttgcagtgagccgagatggcgccactgcactccagcctgggtgacagagcaagactctgtctcaaaaagaaaaaaatgttcagtgatagaaaataattttactaggtttttatgttgattgtactcatgctgttccactccttttaattattaaaaagttatttttggctgggtgtggtggctcatacctgtaatcccagcactttgggaggccgaggcgggtggatcacctgaggtcaggagttcaagaccagtctggccaacat

SEQ ID NO: 15 - protein, 1048 aa, Homo sapiens
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPTDSRT

SEQ ID NO: 16 - DNA, 9036 bp, Homo sapiens
  CDS (735)...(4757)
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatcccatggcctgccccttggctatcctcaggaggagtactttgatcgtgctacacccagcaatcgcactgaaggggatggcaactccgatcctgaatctactttcatacctggactaaagaaagaaataactgttcaaccaactgtggaagaggcctctgacaactgcactcaagaatgtctcatctatggccattctgatgcctgctggatgccggcatctctggatcattccagctcttcacaagcacaggcctctgctctatgccacagcccaccactgtcacaggcctctactcagcaccacagcccaccagtgacacagaccattgttctctgccacagccctccagtgacacagaccatcgcattgtgccacagcccaccaccgatacaggtgtctgctctccaccacagtcctcctctagtgcagggtactgcacttcaccacagcccaccatcagcacaggcctcagccctctgctacagccctcctttagcacaggctgctgcaatcagccacagctcttctctgccacaggttattgccctccatcgtagtcaggcccaatcatcagtcagtttgcagcaaggttgggtgcaaggtgctaatggactatgctctgttgatcagggagtgcaaggtagtgcaacatctcagttttacaccatgtctgaaagacttcatcccagtgatgattcaattaaagtcattcctttgacaaccttcgctccacgccaacaggccagaccgtccagaggtgattcccccattatggaaacacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgtactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataatgttaaaaggtatacgtactctagccttttttggggctttctttttgatttttgtttgtggttttcagtttttttgttgttgttagtgagtctcccttcaaaatacacagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcccctttttactttaatagtttagtgtaaagtacatcagaaataaaactgtatctgacattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccacatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaagaagaaataccaataacacacacagaacaaaaaccatcaaaatctcatatatgaaataaaatatattcttctaagcaaagaaacagtactattcatagaaaacattagttttctcctgttgtctgttatttccttcttttatcctcttaactggccattatcttgtatgtgcacattttataaatgtacagaaacatcaccaacttgattttcttccatagcaaaactgagaaaataccttgtttcagtataacactaaaccaagagacaattgatgtttaatgggggcggttggggttgggggggagtcaatatctcctattgattaacttagacatagattttgtaatgtataacttgatatttaatttatgattaaactgtaattttgtaacataaactgtggtaattgcataatttcattggtgaggatttcctttgaatattgagaaagtttcttttcatgtgcccagcaggttaagtagcgttttcagaatatacattattcccatccattgtaaagttccttaagtcatatttgactgggcgtgcagaataacttcttaactattaactatcagagtttgattaataaaattaattaattttttttctccttcgtgttgttaatgttccaagggatttggagcatactggttttccaggtgcatgtgaatcccgaaggactgatgatatttgaatgtttattaaattattatcacacaaatgtgttgatattgtggctattgttgatgttgaaaattgtaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaacctttagttttctgatgatctacacacacacatacacacacacacacacacacgtgcacacacacacatttaaaggatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgaagttttgacacctttcctatagatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttctcttcctaagcgtccactaggtctggccttggaaatctgttacttctacggcttcagatctgatgatatctttttcatcacattacaagttatttctttgactgaatagacagtggtataggttgacacagcacacaagtggctattgtgatgtatgatgtatgtagtcccacaactgcaaaacgtcttactgaagcaacaatcgaaaaatggttctgttttaaaaaggattttgtttgatttgaaattaaaacttcaaactgaatgacttatatgagaataatatgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaaatccttttcaatcctgagaaaattaaaggtgttttactcacatggatatttcaacattagttttttttgtttgtttctttttcatggtattactgaaggtgtgtatactccctaatacacatttatgaaaatctacttgtttagacttttatttatactcttctgatttatattttttattataattattatttcttatcttcttttatattttttggaaaccaaatttatagttagtttaggtaaactttttattatgaccattagaaactattttgaatgtttccaactggctcaattggctgggaaaacatgggaacaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgactgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaagcatgctttggaagtaagaaggttgactattgtatggccaaggatggcagtatgtaatccagaagcaaacttgtattaattgttctatttcaggttctgtattgcatgttttcttattaatatatattaataaaagttatgagaaat

SEQ ID NO: 17 - protein, 1340 aa, Homo sapiens
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPSQRRVTFHLPEGSQESSSDGGLGDHDAGSLTSTSHGLPLGYPQEEYFDRATPSNRTEGDGNSDPESTFIPGLKKEITVQPTVEEASDNCTQECLIYGHSDACWMPASLDHSSSSQAQASALCHSPPLSQASTQHHSPPVTQTIVLCHSPPVTQTIALCHSPPPIQVSALHHSPPLVQGTALHHSPPSAQASALCYSPPLAQAAAISHSSSLPQVIALHRSQAQSSVSLQQGWVQGANGLCSVDQGVQGSATSQFYTMSERLHPSDDSIKVIPLTTFAPRQQARPSRGDSPIMETHPL

SEQ ID NO: 18 - DNA, 4710 bp, Homo sapiens
  CDS (514)...(3627)
cccctttctccccctctgttaagtccctccccctcgccattcaaaagggctggctcggcactggctccttgcagtcggcgaactgtctgggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgtgaataagaaggattccacagatcacataccagagcggttttgcctcagctgctctcaactttgtaatcttgtgaagaagctgacaagcttggctgattgcagtgcactatgaggactgaatgacagtgggttttaattcagatatttcaagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattgactaacataatattgctgagaaaatcatttttattacccaccactctgcttaaaagttgagtgggccgggcgcggtggctcacgcctgtaattccagcactttgggaggccgaggcgggtggatcacgaggtcaggatattgagaccatcctggctaacatggtgaaaccccatctccactaaaaatacaaaaaattagctgggcgtggtggcgggcgcctgtagtcccagctactcgggaggctgaggcaggagaatggcgtgaacccgggaggcggagcttgcagtgagccgagatggcgccactgcactccagcctgggtgacagagcaagactctgtctcaaaaagaaaaaaatgttcagtgatagaaaataattttactaggtttttatgttgattgtactcatgctgttccactccttttaattattaaaaagttatttttggctgggtgtggtggctcatacctgtaatcccagcactttgggaggccgaggcgggtggatcacctgaggtcaggagttcaagaccagtctggccaacat

SEQ ID NO: 19 - protein, 1037 aa, Homo sapiens
MTVGFNSDISSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPTDSRT

SEQ ID NO: 20 - protein, 1021 aa, Homo sapiens; identical to SEQ ID NO: 3

SEQ ID NO: 21 - protein, 1054 aa, Homo sapiens; identical to SEQ ID NO: 5

SEQ ID NO: 22 - protein, 1347 aa, Homo sapiens; identical to SEQ ID NO: 7

SEQ ID NO: 23 - protein, 1337 aa, Homo sapiens; identical to SEQ ID NO: 9

SEQ ID NO: 24 - protein, 1310 aa, Homo sapiens; identical to SEQ ID NO: 11

SEQ ID NO: 25 - protein, 1037 aa, Homo sapiens [sequence omitted]

SEQ ID NO: 26 - protein, 1048 aa, Homo sapiens; identical to SEQ ID NO: 15

SEQ ID NO: 27 - protein, 1340 aa, Homo sapiens; identical to SEQ ID NO: 17

SEQ ID NO: 28 - protein, 1037 aa, Homo sapiens; identical to SEQ ID NO: 19

SEQ ID NO: 29 - protein, 1021 aa, Homo sapiens; identical to SEQ ID NO: 3

SEQ ID NO: 30 - protein, 1021 aa, Homo sapiens; identical to SEQ ID NO: 3

SEQ ID NO: 31 - protein, 1021 aa, Homo sapiens; identical to SEQ ID NO: 3

SEQ ID NO: 32 - protein, 1054 aa, Homo sapiens; identical to SEQ ID NO: 5

SEQ ID NO: 33 - protein, 1347 aa, Homo sapiens; identical to SEQ ID NO: 7

SEQ ID NO: 34 - protein, 1337 aa, Homo sapiens; identical to SEQ ID NO: 9

SEQ ID NO: 35 - protein, 1310 aa, Homo sapiens; identical to SEQ ID NO: 11

SEQ ID NO: 36 - protein, 1037 aa, Homo sapiens [sequence omitted]

SEQ ID NO: 37 - protein, 1048 aa, Homo sapiens; identical to SEQ ID NO: 15

SEQ ID NO: 38 - protein, 1340 aa, Homo sapiens; identical to SEQ ID NO: 17

SEQ ID NO: 39 - protein, 1037 aa, Homo sapiens; identical to SEQ ID NO: 19

SEQ ID NO: 40 - protein, 14 aa, Tetanus toxoid
QYIKANSKFIGITE

SEQ ID NO: 41 - protein, 21 aa, Plasmodium falciparum
DIEKKIAKMEKASSVFNVVNS

SEQ ID NO: 42 - protein, 16 aa, Streptococcus
GAVDSILGGVATYGAA

SEQ ID NO: 43 - protein, 13 aa, Artificial Sequence
  Pan-DR binding epitope
  VARIANT 3: Xaa = cyclohexylalanine, phenylalanine, or tyrosine
  VARIANT 1, 13: Xaa = D-alanine or L-alanine
XKXVAAWTLKAAX

SEQ ID NO: 44 - DNA, 14 bp, Artificial Sequence
  Primer
ttttgatcaagctt

SEQ ID NO: 45 - DNA, 42 bp, Artificial Sequence
  Primer
ctaatacgactcactatagggctcgagcggccgcccgggcag

SEQ ID NO: 46 - DNA, 12 bp, Artificial Sequence
  Primer
gatcctgcccgg

SEQ ID NO: 47 - DNA, 40 bp, Artificial Sequence
  Primer
gtaatacgactcactatagggcagcgtggtcgcggccgag

SEQ ID NO: 48 - DNA, 10 bp, Artificial Sequence
  Primer
gatcctcggc

SEQ ID NO: 49 - DNA, 22 bp, Artificial Sequence
  Primer
ctaatacgactcactatagggc

SEQ ID NO: 50 - DNA, 22 bp, Artificial Sequence
  Primer
tcgagcggccgcccgggcagga

SEQ ID NO: 51 - DNA, 20 bp, Artificial Sequence
  Primer
agcgtggtcgcggccgagga

SEQ ID NO: 52 - DNA, 25 bp, Artificial Sequence
  Primer
atatcgccgcgctcgtcgtcgacaa

SEQ ID NO: 53 - DNA, 26 bp, Artificial Sequence
  Primer
agccacacgcagctcattgtagaagg

SEQ ID NO: 54 - DNA, 24 bp, Artificial Sequence
  Primer
tggtctttcaggtaattgctgttg

SEQ ID NO: 55 - DNA, 24 bp, Artificial Sequence
  Primer
ctccatcaatgttatgttgcctgt

SEQ ID NO: 56 - DNA, 24 bp, Artificial Sequence
  FLAG sequence
gattacaaggatgacgacgataag

SEQ ID NO: 57 - DNA, 21 bp, Homo sapiens
aagaggatactggtgagatct

SEQ ID NO: 58 - DNA, 21 bp, Homo sapiens
aagagcaatggtgctggtaaa

SEQ ID NO: 59 - DNA, 21 bp, Homo sapiens
aacaccagaaggagacaagat

SEQ ID NO: 60 - DNA, 24 bp, Homo sapiens
aagggacgaagacgaacacuuctt

SEQ ID NO: 61 - DNA, 23 bp, Homo sapiens
aactgaagacctgaagacaataa

SEQ ID NO: 62 - protein, 9 aa, Homo sapiens
DLNLSLIPN

SEQ ID NO: 63 - protein, 9 aa, Homo sapiens
VINISIPEN

SEQ ID NO: 64 - protein, 9 aa, Homo sapiens
IPENSAINS

SEQ ID NO: 65 - protein, 9 aa, Homo sapiens
ILQVSVTDT

SEQ ID NO: 66 - protein, 9 aa, Homo sapiens
EIEVSIPEN

SEQ ID NO: 67 - protein, 9 aa, Homo sapiens
LDYESTKEY

SEQ ID NO: 68 - protein, 9 aa, Homo sapiens
PENNSPGIQ

SEQ ID NO: 69 - protein, 9 aa, Homo sapiens
LTKVSAMDA

SEQ ID NO: 70 - protein, 9 aa, Homo sapiens
MDADSGPNA

SEQ ID NO: 71 - protein, 9 aa, Homo sapiens
TVFVSIIDQ

SEQ ID NO: 72 - protein, 9 aa, Homo sapiens
QNDNSPVFT

SEQ ID NO: 73 - protein, 9 aa, Homo sapiens
AVTLSILDE

SEQ ID NO: 74 - protein, 9 aa, Homo sapiens
RPNISFDRE

SEQ ID NO: 75 - protein, 9 aa, Homo sapiens
EKQESYTFY

SEQ ID NO: 76 - protein, 9 aa, Homo sapiens
GGRVSRSSS

SEQ ID NO: 77 - protein, 9 aa, Homo sapiens
RVSRSSSAK

SEQ ID NO: 78 - protein, 9 aa, Homo sapiens
VSRSSSAKV

SEQ ID NO: 79 - protein, 9 aa, Homo sapiens
SRSSSAKVT

SEQ ID NO: 80 - protein, 9 aa, Homo sapiens
EVRYSIVGG

SEQ ID NO: 81 - protein, 9 aa, Homo sapiens
LVRKSTEAP

SEQ ID NO: 82 - protein, 9 aa, Homo sapiens
ADVSSPTSD

SEQ ID NO: 83 - protein, 9 aa, Homo sapiens
SSPTSDYVK

SEQ ID NO: 84 - protein, 9 aa, Homo sapiens
NKQNSEWAT

SEQ ID NO: 85 - protein, 9 aa, Homo sapiens
KKKHSPKNL

SEQ ID NO: 86 - protein, 9 aa, Homo sapiens
DDVDSDGNR

SEQ ID NO: 87 - protein, 9 aa, Homo sapiens
FKPDSPDLA

SEQ ID NO: 88 - protein, 9 aa, Homo sapiens
RHYKSASPQ

SEQ ID NO: 89 - protein, 9 aa, Homo sapiens
YKSASPQPA

SEQ ID NO: 90 - protein, 9 aa, Homo sapiens
ISKCSSSSS

SEQ ID NO: 91 - protein, 9 aa, Homo sapiens
SKCSSSSSD

SEQ ID NO: 92 - protein, 9 aa, Homo sapiens
KCSSSSSDP

SEQ ID NO: 93 - protein, 9 aa, Homo sapiens
CSSSSSDPY

SEQ ID NO: 94 - protein, 9 aa, Homo sapiens
SDPYSVSDC

SEQ ID NO: 95 - protein, 9 aa, Homo sapiens
EVPVSVHTR

SEQ ID NO: 96 - protein, 9 aa, Homo sapiens
EKNYTIREE

SEQ ID NO: 97 - protein, 9 aa, Homo sapiens
IEEDTGEIF

SEQ ID NO: 98 - protein, 9 aa, Homo sapiens
DVIETPEGD

SEQ ID NO: 99 - protein, 9 aa, Homo sapiens
VFKETEIEV

SEQ ID NO: 100 - protein, 9 aa, Homo sapiens
TGLITIKEP

SEQ ID NO: 101 - protein, 9 aa, Homo sapiens
DREETPNHK

SEQ ID NO: 102 - protein, 9 aa, Homo sapiens
VPPLTSNVT

SEQ ID NO: 103 - protein, 9 aa, Homo sapiens
VRKSTEAPV

SEQ ID NO: 104 - protein, 9 aa, Homo sapiens
SEWATPNPE

SEQ ID NO: 105 - protein, 9 aa, Homo sapiens
NWVTTPTTF

SEQ ID NO: 106 - protein, 9 aa, Homo sapiens
TTPTTFKPD

SEQ ID NO: 107 - protein, 9 aa, Homo sapiens
GYPVTTFEV

SEQ ID NO: 108 - protein, 9 aa, Homo sapiens
YPVTTFEVP

SEQ ID NO: 109 - protein, 9 aa, Homo sapiens
FKLVYKTGD

SEQ ID NO: 110 - protein, 9 aa, Homo sapiens
INSKYTLPA

SEQ ID NO: 111 - protein, 9 aa, Homo sapiens
EKDTYVMKV

SEQ ID NO: 112 - protein, 9 aa, Homo sapiens
IDIRYIVNP

SEQ ID NO: 113 - protein, 9 aa, Homo sapiens
ETAAYLDYE

SEQ ID NO: 114 - protein, 9 aa, Homo sapiens
AYLDYESTK

SEQ ID NO: 115 - protein, 9 aa, Homo sapiens
STKEYAIKL

SEQ ID NO: 116 - protein, 9 aa, Homo sapiens
KEDKYLFTI

SEQ ID NO: 117 - protein, 9 aa, Homo sapiens
TDPDYGDNS

SEQ ID NO: 118 - protein, 9 aa, Homo sapiens
SYTFYVKAE

SEQ ID NO: 119 - protein, 9 aa, Homo sapiens
SNCSYELVL

SEQ ID NO: 120 - protein, 9 aa, Homo sapiens
AEVRYSIVG

SEQ ID NO: 121 - protein, 9 aa, Homo sapiens
PTSDYVKIL

SEQ ID NO: 122 - protein, 9 aa, Homo sapiens
TMGKYNWVT

SEQ ID NO: 123 - protein, 9 aa, Homo sapiens
SSDPYSVSD

SEQ ID NO: 124 - protein, 9 aa, Homo sapiens
SDCGYPVTT

SEQ ID NO: 125 - protein, 1021 aa, Homo sapiens; identical to SEQ ID NO: 3

SEQ ID NO: 126 - protein, 37 aa, Homo sapiens
MRTERQWVLIQIFQVLCGLIQQTVTSVPGMDLLSGTY

SEQ ID NO: 127 - protein, 38 aa, Homo sapiens
MRTERQWVLIQIFQVLCGLIQQTVTSVPGMDLLSGTYI

SEQ ID NO: 128 - protein, 43 aa, Homo sapiens
MRTERQWVLIQIFQVLCGLIQQTVTSVPGMDLLSGTYIFAVLL

SEQ ID NO: 129 - protein, 22 aa, Homo sapiens
PVSVHTRPTDSRTSTIEICSEI

SEQ ID NO: 130 - protein, 23 aa, Homo sapiens
VPVSVHTRPTDSRTSTIEICSEI

SEQ ID NO: 131 - protein, 28 aa, Homo sapiens
VTTFEVPVSVHTRPTDSRTSTIEICSEI

SEQ ID NO: 132 - protein, 343 aa, Homo sapiens
PVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPMEEHPL

SEQ ID NO: 133 - protein, 344 aa, Homo sapiens
VPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPMEEHPL

SEQ ID NO: 134 - protein, 349 aa, Homo sapiens
VTTFEVPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPMEEHPL

SEQ ID NO: 135 - protein, 16 aa, Homo sapiens
IWIHPQPQSQRRVTFH

SEQ ID NO: 136 - protein, 18 aa, Homo sapiens
EIWIHPQPQSQRRVTFHL

SEQ ID NO: 137 - protein, 28 aa, Homo sapiens
ESTTMEIWIHPQPQSQRRVTFHLPEGSQ

SEQ ID NO: 138 - protein, 16 aa, Homo sapiens
PVSVHTRPSQRRVTFH

SEQ ID NO: 139 - protein, 18 aa, Homo sapiens
VPVSVHTRPSQRRVTFHL

SEQ ID NO: 140 - protein, 28 aa, Homo sapiens
VTTFEVPVSVHTRPSQRRVTFHLPEGSQ

SEQ ID NO: 141 - protein, 31 aa, Homo sapiens
MTVGFNSDISSVVRVNTTNCHKCLLSGTYIF

SEQ ID NO: 142 - protein, 32 aa, Homo sapiens
MTVGFNSDISSVVRVNTTNCHKCLLSGTYIFA

SEQ ID NO: 143 - protein, 37 aa, Homo sapiens
MTVGFNSDISSVVRVNTTNCHKCLLSGTYIFAVLLVC

SEQ ID NO: 144 - protein, 13 aa, Homo sapiens
PVSVHTRPTDSRT

SEQ ID NO: 145 - protein, 14 aa, Homo sapiens
VPVSVHTRPTDSRT

SEQ ID NO: 146 - protein, 19 aa, Homo sapiens
VTTFEVPVSVHTRPTDSRT

SEQ ID NO: 147 - protein, 29 aa, Homo sapiens
MFRVGFLIISSSSSLSPLLLVSVVRVNTT

SEQ ID NO: 148 - protein, 30 aa, Homo sapiens
MFRVGFLIISSSSSLSPLLLVSVVRVNTTN

SEQ ID NO: 149 - protein, 35 aa, Homo sapiens
MFRVGFLIISSSSSLSPLLLVSVVRVNTTNCHKCL

SEQ ID NO: 150 - protein, 16 aa, Homo sapiens
TFIPGLKKEITVQPTV

SEQ ID NO: 151 - protein, 18 aa, Homo sapiens
STFIPGLKKEITVQPTVE

SEQ ID NO: 152 - protein, 28 aa, Homo sapiens
NSDPESTFIPGLKKEITVQPTVEEASDN

SEQ ID NO: 153 - protein, 17 aa, Homo sapiens
TYIFAVLLVCVVFHSGA

SEQ ID NO: 154 - protein, 19 aa, Homo sapiens
GTYIFAVLLVCVVFHSGAQ

SEQ ID NO: 155 - protein, 29 aa, Homo sapiens
MDLLSGTYIFAVLLVCVVFHSGAQEKNYT

SEQ ID NO: 156 - protein, 17 aa, Homo sapiens
KNYTIREEIPENVLIGD

SEQ ID NO: 157 - protein, 19 aa, Homo sapiens
EKNYTIREEIPENVLIGDL

SEQ ID NO: 158 - protein, 29 aa, Homo sapiens
HSGAQEKNYTIREEIPENVLIGDLLKDLN

SEQ ID NO: 159 - protein, 17 aa, Homo sapiens
KNYTIREEIPENVLIGN

SEQ ID NO: 160 - protein, 19 aa, Homo sapiens
EKNYTIREEIPENVLIGNL

SEQ ID NO: 161 - protein, 29 aa, Homo sapiens
HSGAQEKNYTIREEIPENVLIGNLLKDLN

SEQ ID NO: 162 - protein, 17 aa, Homo sapiens
MPENVLIGNLLKDLNLS

SEQ ID NO: 163 - protein, 19 aa, Homo sapiens
EMPENVLIGNLLKDLNLSL

SEQ ID NO: 164 - protein, 29 aa, Homo sapiens
YTIREEMPENVLIGNLLKDLNLSLIPNKS

SEQ ID NO: 165 - protein, 17 aa, Homo sapiens
IPENVLIGNLLKDLNLS

SEQ ID NO: 166 - protein, 19 aa, Homo sapiens
EIPENVLIGNLLKDLNLSL

SEQ ID NO: 167 - protein, 29 aa, Homo sapiens
YTIREEIPENVLIGNLLKDLNLSLIPNKS

SEQ ID NO: 168 - protein, 17 aa, Homo sapiens
IPNKSLTTTMQFKLVYK

SEQ ID NO: 169 - protein, 19 aa, Homo sapiens
LIPNKSLTTTMQFKLVYKT

SEQ ID NO: 170 - protein, 30 aa, Homo sapiens
DLNLSLIPNKSLTTTMQFKLVYKTGDVPLI

SEQ ID NO: 171 - protein, 17 aa, Homo sapiens
ISIPENSAVNSKYTLPA

SEQ ID NO: 172 - protein, 19 aa, Homo sapiens
NISIPENSAVNSKYTLPAA

SEQ ID NO: 173 - protein, 29 aa, Homo sapiens
PATVINISIPENSAVNSKYTLPAAVDPDV

SEQ ID NO: 174 - protein, 17 aa, Homo sapiens
IHFSFSNLISNIARRLF

SEQ ID NO: 175 - protein, 19 aa, Homo sapiens
KIHFSFSNLISNIARRLFH

SEQ ID NO: 176 - protein, 29 aa, Homo sapiens
IGENAKIHFSFSNLISNIARRLFHLNATT

SEQ ID NO: 177 - protein, 17 aa, Homo sapiens
FSNQFLLENAAYLDYES

SEQ ID NO: 178 - protein, 19 aa, Homo sapiens
VFSNQFLLENAAYLDYEST

SEQ ID NO: 179 - protein, 29 aa, Homo sapiens
FRLRPVFSNQFLLENAAYLDYESTKEYAI

SEQ ID NO: 180 - protein, 17 aa, Homo sapiens
NNSPGIQLMKVSAMDAD

SEQ ID NO: 181 - protein, 19 aa, Homo sapiens
ENNSPGIQLMKVSAMDADS

SEQ ID NO: 182 - protein, 29 aa, Homo sapiens [sequence omitted]

SEQ ID NO: 183 - protein, 17 aa, Homo sapiens
NNSPGIQLMKVSATDAD

SEQ ID NO: 184 - protein, 19 aa, Homo sapiens
ENNSPGIQLMKVSATDADS

SEQ ID NO: 185 - protein, 29 aa, Homo sapiens
TVSIPENNSPGIQLMKVSATDADSGPNAK

SEQ ID NO: 186 - protein, 29 aa, Homo sapiens
TVSIPENNSPGIQLMKVSATDADSGPNAE

SEQ ID NO: 187 - protein, 29 aa, Homo sapiens
TVSIPENNSPGIQLMKVSAMDADSGPNAE

SEQ ID NO: 188 - protein, 17 aa, Homo sapiens
IQLTKVSATDADSGPNA

SEQ ID NO: 189 - protein, 19 aa, Homo sapiens
GIQLTKVSATDADSGPNAK

SEQ ID NO: 190 - protein, 29 aa, Homo sapiens
ENNSPGIQLTKVSATDADSGPNAKINYLL

SEQ ID NO: 191 - protein, 17 aa, Homo sapiens
IQLNKVSATDADSGPNA

SEQ ID NO: 192 - protein, 19 aa, Homo sapiens
GIQLNKVSATDADSGPNAK

SEQ ID NO: 193 - protein, 29 aa, Homo sapiens
ENNSPGIQLNKVSATDADSGPNAKINYLL

SEQ ID NO: 194 - protein, 19 aa, Homo sapiens
GIQLNKVSATDADSGPNAE

SEQ ID NO: 195 - protein, 29 aa, Homo sapiens
ENNSPGIQLNKVSATDADSGPNAEINYLL

SEQ ID NO: 196 - protein, 29 aa, Homo sapiens
ENNSPGIQLTKVSATDADSGPNAEINYLL

SEQ ID NO: 197 - protein, 17 aa, Homo sapiens
DADSGPNAEINYLLGPD

SEQ ID NO: 198 - protein, 19 aa, Homo sapiens
MDADSGPNAEINYLLGPDA

SEQ ID NO: 199 - protein, 29 aa, Homo sapiens
TKVSAMDADSGPNAEINYLLGPDAPPEFS

SEQ ID NO: 200 - protein, 19 aa, Homo sapiens
TDADSGPNAEINYLLGPDA

SEQ ID NO: 201 - protein, 29 aa, Homo sapiens
TKVSATDADSGPNAEINYLLGPDAPPEFS

SEQ ID NO: 202 - protein, 29 aa, Homo sapiens
MKVSATDADSGPNAEINYLLGPDAPPEFS

SEQ ID NO: 203 - protein, 29 aa, Homo sapiens
MKVSAMDADSGPNAEINYLLGPDAPPEFS

SEQ ID NO: 204 - protein, 17 aa, Homo sapiens
APPEFSLDRRTGMLTVV

SEQ ID NO: 205 - protein, 19 aa, Homo sapiens
DAPPEFSLDRRTGMLTVVK

SEQ ID NO: 206 - protein, 31 aa, Homo sapiens
INYLLGPDAPPEFSLDRRTGMLTVVKKLDRE

SEQ ID NO: 207 - protein, 17 aa, Homo sapiens
PVFTHNEYKFYVPENLP

SEQ ID NO: 208 - protein, 19 aa, Homo sapiens
SPVFTHNEYKFYVPENLPR

SEQ ID NO: 209 - protein, 29 aa, Homo sapiens
DQNDNSPVFTHNEYKFYVPENLPRHGTVG

SEQ ID NO: 210 - protein, 19 aa, Homo sapiens
KPVFIVPPYNCSYELVLPS

SEQ ID NO: 211 - protein, 21 aa, Homo sapiens
NKPVFIVPPYNCSYELVLPST

SEQ ID NO: 212 - protein, 29 aa, Homo sapiens
VDVNDNKPVFIVPPYNCSYELVLPSTNPG

SEQ ID NO: 213 - protein, 19 aa, Homo sapiens
KPVFIVPPYNYSYELVLPS

SEQ ID NO: 214 - protein, 21 aa, Homo sapiens
NKPVFIVPPYNYSYELVLPST

SEQ ID NO: 215 - protein, 29 aa, Homo sapiens
VDVNDNKPVFIVPPYNYSYELVLPSTNPG

SEQ ID NO: 216 - protein, 17 aa, Homo sapiens
VFIVPPSNYSYELVLPS

SEQ ID NO: 217 - protein, 19 aa, Homo sapiens
PVFIVPPSNYSYELVLPST

SEQ ID NO: 218 - protein, 29 aa, Homo sapiens
VNDNKPVFIVPPSNYSYELVLPSTNPGTV

SEQ ID NO: 219 - protein, 17 aa, Homo sapiens
VFIVPPYNYSYELVLPS

SEQ ID NO: 220 - protein, 19 aa, Homo sapiens
PVFIVPPYNYSYELVLPST

SEQ ID NO: 221 - protein, 29 aa, Homo sapiens
VNDNKPVFIVPPYNYSYELVLPSTNPGTV

SEQ ID NO: 222 - protein, 17 aa, Homo sapiens
INELVRKSIEAPVTPNT

SEQ ID NO: 223 - protein, 19 aa, Homo sapiens
LINELVRKSIEAPVTPNTE

SEQ ID NO: 224 - protein, 29 aa, Homo sapiens
VTNATLINELVRKSIEAPVTPNTEIADVS

SEQ ID NO: 225 - protein, 17 aa, Homo sapiens
HLKAAQKNMQNSEWATP

SEQ ID NO: 226 - protein, 19 aa, Homo sapiens
PHLKAAQKNMQNSEWATPN

SEQ ID NO: 227 - protein, 29 aa, Homo sapiens
RCRQAPHLKAAQKNMQNSEWATPNPENRQ

SEQ ID NO: 228 - protein, 17 aa, Homo sapiens
SPKNLLLNVVTIEETKA

SEQ ID NO: 229 - protein, 19 aa, Homo sapiens
HSPKNLLLNVVTIEETKAD

SEQ ID NO: 230 - protein, 29 aa, Homo sapiens
KKKKKHSPKNLLLNVVTIEETKADDVDSD

SEQ ID NO: 231 - protein, 17 aa, Homo sapiens
IQPETPLNLKHHIIQEL

SEQ ID NO: 232 - protein, 19 aa, Homo sapiens
QIQPETPLNLKHHIIQELP

SEQ ID NO: 233 - protein, 29 aa, Homo sapiens
PQPAFQIQPETPLNLKHHIIQELPLDNTF

SEQ ID NO: 234 - protein, 17 aa, Homo sapiens
FVACDSISNCSSSSSDP

SEQ ID NO: 235 - protein, 19 aa, Homo sapiens
TFVACDSISNCSSSSSDPY

SEQ ID NO: 236 - protein, 29 aa, Homo sapiens
LPLDNTFVACDSISNCSSSSSDPYSVSDC

SEQ ID NO: 237 - DNA, 4723 bp, Homo sapiens; identical to SEQ ID NO: 4

SEQ ID NO: 238 - DNA, 3080 bp, Homo sapiens
vagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccg

SEQ ID NO: 239 - DNA, 4723 bp, Homo sapiens; identical to SEQ ID NO: 4

SEQ ID NO: 240 - protein, 1054 aa, Homo sapiens; identical to SEQ ID NO: 5

SEQ ID NO: 241 - protein, 1017 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPVGIQVS

SEQ ID NO: 242 - protein, 1054 aa, Homo sapiens; identical to SEQ ID NO: 5

SEQ ID NO: 243 - DNA, 9176 bp, Homo sapiens; identical to SEQ ID NO: 6

SEQ ID NO: 244 - DNA, 9176 bp, Homo sapiens; identical to SEQ ID NO: 6

SEQ ID NO: 245 - DNA, 9176 bp, Homo sapiens; identical to SEQ ID NO: 6

SEQ ID NO: 246 - protein, 1347 aa, Homo sapiens; identical to SEQ ID NO: 7

SEQ ID NO: 247 - protein, 1347 aa, Homo sapiens; identical to SEQ ID NO: 7

SEQ ID NO: 248 - protein, 1347 aa, Homo sapiens; identical to SEQ ID NO: 7

SEQ ID NO: 249 - DNA, 9146 bp, Homo sapiens; identical to SEQ ID NO: 8

SEQ ID NO: 250 - DNA, 3878 bp, Homo sapiens
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccg

SEQ ID NO: 251 - DNA, 3878 bp, Homo sapiens; identical to SEQ ID NO: 250

SEQ ID NO: 252 - protein, 1337 aa, Homo sapiens; identical to SEQ ID NO: 9

SEQ ID NO: 253 - protein, 1011 aa, Homo sapiens
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRP

SEQ ID NO: 254 - protein, 1011 aa, Homo sapiens; identical to SEQ ID NO: 253

SEQ ID NO: 255 - DNA, 9065 bp, Homo sapiens; identical to SEQ ID NO: 10

SEQ ID NO: 256 - DNA, 3878 bp, Homo sapiens; identical to SEQ ID NO: 250

SEQ ID NO: 257 - DNA, 3878 bp, Homo sapiens; identical to SEQ ID NO: 250

SEQ ID NO: 258 - protein, 1310 aa, Homo sapiens; identical to SEQ ID NO: 11

SEQ ID NO: 259 - protein, 1011 aa, Homo sapiens; identical to SEQ ID NO: 253

SEQ ID NO: 260 - protein, 1011 aa, Homo sapiens; identical to SEQ ID NO: 253

SEQ ID NO: 261 - DNA, 4830 bp, Homo sapiens; identical to SEQ ID NO: 12
  misc_feature (0)...(0): n = a, t, c, or g

SEQ ID NO: 262 - DNA, 3027 bp, Homo sapiens
ttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccg

SEQ ID NO: 263 - DNA, 3027 bp, Homo sapiens
ttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaattttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaagtgttcctcaagcagttcagatccctacagcgtttctgactgtggctatccagtgacaaccttcgaggtacctgtgtccgtacacaccagaccg

SEQ ID NO: 264 - protein, 1037 aa, Homo sapiens [sequence omitted]

SEQ ID NO: 265 - protein, 1009 aa, Homo sapiens
LLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRP

SEQ ID NO: 266 - protein, 1009 aa, Homo sapiens
LLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNLKHHIIQELPLDNTFVACDSISKCSSSSSDPYSVSDCGYPVTTFEVPVSVHTRP

SEQ ID NO: 267 - DNA, 4964 bp, Homo sapiens; identical to SEQ ID NO: 14

SEQ ID NO: 268 - DNA, 3863 bp, Homo sapiens
ttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgt

SEQ ID NO: 269 - DNA, 3863 bp, Homo sapiens
ttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgt

SEQ ID NO: 270 - protein, 1048 aa, Homo sapiens; identical to SEQ ID NO: 15

SEQ ID NO: 271 - protein, 1009 aa, Homo sapiens; identical to SEQ ID NO: 265

SEQ ID NO: 272 - protein, 1009 aa, Homo sapiens
LLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRP

SEQ ID NO: 273 - DNA, 9036 bp, Homo sapiens; identical to SEQ ID NO: 16

SEQ ID NO: 274 - DNA, 3863 bp, Homo sapiens; identical to SEQ ID NO: 268

SEQ ID NO: 275 - DNA, 3863 bp, Homo sapiens; identical to SEQ ID NO: 269

SEQ ID NO: 276 - protein, 1340 aa, Homo sapiens; identical to SEQ ID NO: 17

SEQ ID NO: 277 - protein, 1009 aa, Homo sapiens; identical to SEQ ID NO: 265

SEQ ID NO: 278 - protein, 1009 aa, Homo sapiens; identical to SEQ ID NO: 272

SEQ ID NO: 279 - DNA, 4710 bp, Homo sapiens; identical to SEQ ID NO: 18

SEQ ID NO: 280 - DNA, 3027 bp, Homo sapiens; identical to SEQ ID NO: 262

SEQ ID NO: 281 - DNA, 3027 bp, Homo sapiens
ttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccg

SEQ ID NO: 282 - protein, 1037 aa, Homo sapiens; identical to SEQ ID NO: 19

SEQ ID NO: 283 - protein, 1009 aa, Homo sapiens; identical to SEQ ID NO: 265

SEQ ID NO: 284 - protein, 1009 aa, Homo sapiens; identical to SEQ ID NO: 272

The invention claimed is:

1. A method of delivering a cytotoxic agent to a cell expressing a 109P1D4 protein, which protein comprises SEQ ID NO:3, comprising providing to the cell an effective amount of an antibody or fragment thereof that immunospecifically binds to an epitope on SEQ ID NO:3, which antibody or fragment is coupled to a cytotoxic agent.

2. The method of claim 1, wherein the cytotoxic agent is selected from the group consisting of taxol, actinomycin, mitomycin, etoposide, teniposide, vincristine, vinblastine, colchicine, gelonin, and calicheamicin.

3. The method of claim 1, wherein the cytotoxic agent is selected from the group consisting of diphtheria toxin, enomycin, phenomycin, Pseudomonas exotoxin (PE) A, PE40, abrin, abrin A chain, mitogellin, modeccin A chain, and alpha-sarcin.

4. The method of claim 1, wherein the cell is a cancer cell.

5. The method of claim 4, wherein the cancer cell is a lymphoma.

6. The method of claim 1, wherein the fragment is an Fab, F(ab')$_2$, Fv or Sfv fragment.

7. The method of claim 1, wherein the antibody or fragment thereof is monoclonal.

8. The method of claim 7, wherein the monoclonal antibody is a recombinant protein.

9. The method of claim 8, wherein the antibody or fragment thereof is a single chain monoclonal antibody.

10. The method of claim 7, wherein the antibody or fragment thereof is a human or humanized antibody.

* * * * *